（12）United States Patent
Schrodi et al.

(10) Patent No.: US 11,008,618 B2
(45) Date of Patent: May 18, 2021

(54) GENETIC POLYMORPHISMS ASSOCIATED WITH AUTOINFLAMMATORY DISEASES, METHODS OF DETECTION AND USES THEREOF

(71) Applicant: CELERA CORPORATION, San Clemente, CA (US)

(72) Inventors: Steven Schrodi, Marshfield, WI (US); Yonghong Li, Palo Alto, CA (US)

(73) Assignee: Celera Corporation, San Juan Capistrano, CA (US)

( * ) Notice: Subject to any disclaimer, the term of this patent is extended or adjusted under 35 U.S.C. 154(b) by 65 days.

(21) Appl. No.: 15/788,125

(22) Filed: Oct. 19, 2017

(65) Prior Publication Data

US 2018/0171407 A1    Jun. 21, 2018

Related U.S. Application Data

(63) Continuation of application No. 14/960,707, filed on Dec. 7, 2015, now abandoned, which is a continuation of application No. 13/855,547, filed on Apr. 2, 2013, now abandoned, which is a continuation of application No. 12/494,800, filed on Jun. 30, 2009, now abandoned.

(60) Provisional application No. 61/134,042, filed on Jul. 2, 2008.

(51) Int. Cl.
*C12Q 1/6883* (2018.01)
*C07K 16/24* (2006.01)

(52) U.S. Cl.
CPC .......... *C12Q 1/6883* (2013.01); *C07K 16/244* (2013.01); *C12Q 2600/106* (2013.01); *C12Q 2600/136* (2013.01); *C12Q 2600/156* (2013.01); *C12Q 2600/158* (2013.01); *C12Q 2600/172* (2013.01)

(58) Field of Classification Search
None
See application file for complete search history.

*Primary Examiner* — Katherine D Salmon
(74) *Attorney, Agent, or Firm* — Celera Corporation

(57) ABSTRACT

The present invention provides compositions and methods based on genetic polymorphisms that are associated with autoinflammatory diseases such as psoriasis. For example, the present invention relates to nucleic acid molecules containing the polymorphisms, variant proteins encoded by these nucleic acid molecules, reagents for detecting the polymorphic nucleic acid molecules and variant proteins, and methods of using the nucleic acid molecules and proteins as well as methods of using reagents for their detection.

15 Claims, No Drawings
Specification includes a Sequence Listing.

GENETIC POLYMORPHISMS ASSOCIATED WITH AUTOINFLAMMATORY DISEASES, METHODS OF DETECTION AND USES THEREOF

CROSS-REFERENCE TO RELATED APPLICATIONS

This application is a continuation of U.S. non-provisional application Ser. No. 14/960,707, filed Dec. 7, 2015, which is a continuation application of U.S. non-provisional application Ser. No. 13/855,547, filed Apr. 2, 2013, which is a continuation application of U.S. non-provisional application Ser. No. 12/494,800, filed Jun. 30, 2009, which is a non-provisional application of U.S. provisional application Ser. No. 61/134,042, filed Jul. 2, 2008, the contents of each of which are hereby incorporated by reference in their entirety into this application.

FIELD OF THE INVENTION

The present invention is in the field of diagnosis and therapy of autoinflammatory diseases, as well as drug response. In particular, the present invention relates to specific single nucleotide polymorphisms (SNPs) in the human genome, and their association with psoriasis and related pathologies. The SNPs disclosed herein can be used as targets for the design of diagnostic reagents and the development of therapeutic agents, as well as for disease association and linkage analysis. In particular, the SNPs of the present invention are useful for such uses as identifying an individual who has an increased or decreased risk of developing psoriasis, for early detection of the disease, for providing clinically important information for the prevention and/or treatment of psoriasis, for predicting progression or recurrence of psoriasis, for predicting the seriousness or consequences of psoriasis in an individual, for determining the prognosis of an individual's recovery from psoriasis, for screening and selecting therapeutic agents, and for predicting a patient's response to therapeutic agents (such as evaluating the likelihood of an individual responding positively to a particular therapeutic agent), particularly for the treatment or prevention of psoriasis. The SNPs disclosed herein are also useful for human identification applications. Methods, assays, kits, and reagents for detecting the presence of these polymorphisms and their encoded products are provided.

BACKGROUND OF THE INVENTION

Examples of autoinflammatory diseases include inflammatory and autoimmune disorders such as psoriasis, inflammatory bowel disease (IBD) (including Crohn's disease, which further includes both adult and pediatric Crohn's disease, and ulcerative colitis) and other chronic inflammatory disorders, atopic dermatitis, multiple sclerosis, rheumatoid arthritis (RA), ankylosing spondylitis (AS), celiac disease, Graves' disease (including Graves' ophthalmopathy (GO) and Graves' disease without opthalmopathy), and Barrett's esophagus.

Psoriasis is described here as an example of an autoinflammatory disease.

Psoriasis

Psoriasis is a common, chronic, T-cell-mediated inflammatory disease of the skin affecting ~2-3% of whites of European descent. Although this disease is found in all populations, its prevalence is lower in Asians and African-Americans and also declines at lower latitudes. The most common form, psoriasis vulgaris, is characterized by varying numbers of red, raised, scaly skin patches that can be present on any body surface, but most often appear on the elbows, knees and scalp. The onset of disease usually occurs early in life (15-30 years) and affects males and females equally. Up to 30% of individuals with psoriasis will develop an inflammatory arthritis, which can affect the peripheral joints of the hands and feet, large joints, or the central axial-skeleton. Pathologically, psoriasis is characterized by vascular changes, hyperproliferation of keratinocytes, altered epidermal differentiation and inflammation. In particular, the reaction of cells in the epidermis to type 1 effector molecules produced by T-cells results in the characteristic pathology of the plaques.

The genetics of psoriasis are complex and highly heritable as evidenced by an increased rate of concordance in monozygotic twins over dizygotic twins (35%-72% vs. 12-23%) and a substantially increased incidence in family members of affected individuals (first-degree relatives 6%); however, it is clear that environmental effects are also responsible for disease susceptibility. Ten genome-wide linkage scans have resulted in strong evidence for a susceptibility locus in the MHC region on 6p21 (PSORS1 [MIM 177900]), but have not yielded consistent evidence for other regions.

Linkage and association in the MHC (6p21) are thought to be due to HLA-C, in particular psoriasis susceptibility effects are thought to be caused by the *0602 allele, although other candidate genes in the area may also contribute to disease predisposition. Association studies have identified three genes under linkage peaks, with considerable evidence for linkage disequilibrium with psoriasis, namely SLC9A3R1/NAT9 and RAPTOR (KIAA1303) in 17q25, and SLC12A8 in 3q21. Several other genes including VDR, MMP2, IL10, IL1RN, IL12B, and IRF2 (Genetic Association Database, OMIM) have been associated with psoriasis in sample sets of varying sizes and of different ethnicities; however, without more data from additional independent studies, it is difficult to draw statistically sound conclusions about whether these markers are truly associated with disease. Thus, there remains a need for the discovery of reliable markers that can associate themselves with psoriasis, and in turn, would facilitate the diagnosis and treatment of the disease. The discovery of genetic markers which are useful in identifying psoriasis individuals who are at increased risk for developing psoriasis may lead to, for example, better therapeutic strategies, economic models, and health care policy decisions.

Single Nucleotide Polymorphisms (SNPs)

The genomes of all organisms undergo spontaneous mutation in the course of their continuing evolution, generating variant forms of progenitor genetic sequences. Gusella, *Ann Rev Biochem* 55:831-854 (1986). A variant form may confer an evolutionary advantage or disadvantage relative to a progenitor form or may be neutral. In some instances, a variant form confers an evolutionary advantage to the species and is eventually incorporated into the DNA of many or most members of the species and effectively becomes the progenitor form. Additionally, the effects of a variant form may be both beneficial and detrimental, depending on the circumstances. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence gives rise to genetic polymorphisms, including SNPs.

Approximately 90% of all genetic polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker, or marker) is usually preceded by and followed by highly conserved sequences of the allele (e.g., sequences that vary in less than 1/100 or 1/1000 members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel." Weber et al., "Human diallelic insertion/deletion polymorphisms," *Am J Hum Genet* 71(4): 854-62 (October 2002).

A synonymous codon change, or silent mutation/SNP (terms such as "SNP," "polymorphism," "mutation," "mutant," "variation," and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of the SNPs are bi-allelic, and are thus often referred to as "bi-allelic markers," or "di-allelic markers."

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases. Stephens et al., *Science* 293:489-493 (July 2001).

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence. In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as psoriasis, and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as pathologies related to psoriasis. Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. Linder et al., *Clinical Chemistry* 43:254 (1997); Marshall, *Nature Biotechnology* 15:1249 (1997); International Patent Application WO 97/40462, Spectra Biomedical; and Schafer et al., *Nature Biotechnology* 16:3 (1998).

SUMMARY OF THE INVENTION

The present invention relates to the identification of SNPs, as well as unique combinations of such SNPs and haplotypes of SNPs, that are associated with autoinflammatory diseases such as psoriasis, particularly an increased or decreased risk of developing autoinflammatory diseases and responsiveness to therapies used to treat autoinflammatory diseases. The polymorphisms disclosed herein are directly useful as targets for the design of diagnostic and prognostic reagents and the development of therapeutic and preventive agents for use in the diagnosis, prognosis, treatment, and/or prevention of psoriasis, as well as for predicting a patient's response to therapeutic agents, particularly for the treatment or prevention of psoriasis.

Based on the identification of SNPs associated with psoriasis, the present invention also provides methods of detecting these variants as well as the design and preparation of detection reagents needed to accomplish this task. The invention specifically provides, for example, SNPs associated with psoriasis, isolated nucleic acid molecules (including DNA and RNA molecules) containing these SNPs, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of developing psoriasis, methods for determining the risk of an individual for recurring psoriasis, methods for prognosing the severity or consequences of psoriasis, methods of treating an individual who has an increased risk for psoriasis, and methods for identifying individuals (e.g., determining a particular individual's likelihood) who have an altered (i.e., increased or decreased) likelihood of responding to a drug treatment, particularly drug treatment of psoriasis, based on the presence or absence of one or more particular nucleotides (alleles) at one or more SNP sites disclosed herein or the detection of one or more encoded variant products (e.g., variant mRNA transcripts or variant proteins), methods of identifying individuals who are more or less likely to respond to a treatment (or more or less likely to experience undesirable side effects from a treatment), methods of screening for compounds useful in the treatment or prevention of a disorder associated with a variant gene/protein, compounds identified by these methods, methods of treating or preventing disorders mediated by a variant gene/protein, methods of using the novel SNPs of the present invention for human identification, etc.

The present invention further provides methods for selecting or formulating a treatment regimen (e.g., methods for determining whether or not to administer a drug treatment to an individual having psoriasis, or who is at risk for developing psoriasis in the future, or who has previously had psoriasis, methods for selecting a particular treatment regimen such as dosage and frequency of administration of a drug, or a particular form/type of a drug such as a particular pharmaceutical formulation or compound, methods for administering an alternative treatment to individuals who are predicted to be unlikely to respond positively to a particular treatment, etc.), and methods for determining the likelihood of experiencing toxicity or other undesirable side effects from a drug treatment, etc. The present invention also provides methods for selecting individuals to whom a therapeutic agent will be administered based on the individual's genotype, and methods for selecting individuals for a clinical trial of a therapeutic agent based on the genotypes of the individuals (e.g., selecting individuals to participate in the trial who are most likely to respond positively from a drug treatment and/or excluding individuals from the trial who are unlikely to respond positively from a drug treatment based on their SNP genotype(s), or selecting individuals who are unlikely to respond positively to a particular drug treatment based on their SNP genotype(s) to participate in a clinical trial of another type of drug that may benefit them). The present invention further provides methods for reducing an individual's risk of developing psoriasis using a drug treatment, including preventing recurring psoriasis using a drug treatment, when said individual carries one or more SNP alleles identified herein as being associated with psoriasis.

In Tables 1 and 2, the present invention provides gene information, references to the identification of transcript sequences (SEQ ID NOS:1-2), encoded amino acid sequences (SEQ ID NOS:3-4), genomic sequences (SEQ ID NOS:13-20), transcript-based context sequences (SEQ ID NOS:5-12) and genomic-based context sequences (SEQ ID NOS:21-307) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The actual transcript sequences (SEQ ID NOS:1-2), amino acid sequences (SEQ ID NOS:3-4), genomic sequences (SEQ ID NOS:13-20), transcript-based SNP context sequences (SEQ ID NOS:5-12), and genomic-based SNP context sequences (SEQ ID NOS:21-307), together with primer sequences (SEQ ID NOS:308-541) are provided in the Sequence Listing.

In certain exemplary embodiments, the invention provides methods for identifying an individual who has an altered risk for developing psoriasis (including, for example, a first incidence and/or a recurrence of the disease), in which the method comprises detecting a single nucleotide polymorphism (SNP) in any one of the nucleotide sequences of SEQ ID NOS:1-2, SEQ ID NOS:5-12, SEQ ID NOS:13-20, and SEQ ID NOS:21-307 in said individual's nucleic acids, wherein the SNP is specified in Table 1 and/or Table 2, and the presence of the SNP is indicative of an altered risk for psoriasis in said individual. In certain exemplary embodiments of the invention, SNPs that occur naturally in the human genome are provided as isolated nucleic acid molecules. These SNPs are associated with psoriasis such that they can have a variety of uses in the diagnosis, prognosis, treatment, and/or prevention of psoriasis and related pathologies (e.g., Crohn's disease and other autoinflammatory diseases). In an alternative embodiment, a nucleic acid of the invention is an amplified polynucleotide, which is produced by amplification of a SNP-containing nucleic acid template. In another embodiment, the invention provides for a variant protein that is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein that is encoded by a nucleic acid molecule containing a SNP disclosed herein. A preferred embodiment of a protein detection reagent is an antibody or an antigen-reactive antibody fragment.

Various embodiments of the invention also provide kits comprising SNP detection reagents, and methods for detecting the SNPs disclosed herein by employing detection reagents. In a specific embodiment, the present invention provides for a method of identifying an individual having an increased or decreased risk of developing psoriasis by detecting the presence or absence of one or more SNP alleles disclosed herein. In another embodiment, a method for diagnosis of psoriasis by detecting the presence or absence of one or more SNP alleles disclosed herein is provided. The present invention also provides methods for evaluating whether an individual is likely (or unlikely) to respond to a drug treatment, particularly treatment of psoriasis, by detecting the presence or absence of one or more SNP alleles disclosed herein.

For example, the SNP allele can be an allele of an IL12B region SNP selected from the group consisting of rs2546892, rs1433048, rs6894567, rs17860508, rs7709212, rs953861, rs6869411, rs1833754, rs6861600, rs1368437, rs2082412, rs7730390, rs3181225, rs1368439, rs3212227, rs3213120, rs3213119, and rs2853696 (see Tables 9-10), and the SNPs provided in Table 11 (e.g., rs1422878), or a combination of any number of these. Exemplary combinations include combinations consisting of, consisting essentially of, and comprising the nine IL12B region SNPs rs2546892, rs1433048, rs6894567, rs17860508, rs7709212, rs953861, rs6869411, rs1833754, and rs6861600 (see Table 9) and combinations consisting of, consisting essentially of, and comprising the nine IL12B region SNPs rs1368437, rs2082412, rs7730390, rs3181225, rs1368439, rs3212227, rs3213120, rs3213119, and rs2853696 (see Table 10). These and other combinations can further include one or more SNPs provided in Table 11 (e.g., rs1422878).

Further, the SNP allele can be an allele of an IL23R region SNP selected from the group consisting of rs7530511, rs10489629, rs4655692, rs2201841, rs11465804, rs10489628, rs1343152, rs10789229, rs10889671, rs11209026, rs10889674, rs12085634, rs1343151, rs1008193, rs6693831, rs10889675, rs11465827, rs10889677, rs4655531, rs11209030, rs1857292, rs11209031, and rs11209032 (see Table 7), including combinations consisting of, consisting essentially of, and comprising any of these 23 SNPs. Exemplary combinations include combinations consisting of, consisting essentially of, and comprising the five IL23R region SNPs rs7530511, rs11465804, rs10889671, rs11209026, and rs1857292 (see Table 5), combinations consisting of, consisting essentially of, and comprising the three IL23R region SNPs rs7530511, rs10889671, and rs11209026 (see Table 6), and combinations consisting of, consisting essentially of, and comprising the twelve IL23R region SNPs rs2201841, rs10489628, 10889674, rs12085634, rs1008193, rs10889675, rs11465827, rs10889677, rs4655531, rs11209030, rs11209031, and rs11209032 (see Table 8).

In certain exemplary embodiments, the invention provides haplotypes consisting of, consisting essentially of, and comprising the nine IL12B region SNPs rs2546892, rs1433048, rs6894567, rs17860508, rs7709212, rs953861, rs6869411, rs1833754, and rs6861600 (see Table 9), as well as each of these SNPs individually, any combination of any of these SNPs, and compositions and methods based on these SNP haplotypes, combinations of SNPs, and individual SNPs, particularly methods related to psoriasis or related pathologies (e.g., Crohn's disease).

In further exemplary embodiments, the invention provides haplotypes consisting of, consisting essentially of, and comprising the nine IL12B region SNPs rs1368437, rs2082412, rs7730390, rs3181225, rs1368439, rs3212227, rs3213120, rs3213119, and rs2853696 (see Table 10), as well as each of these SNPs individually, any combination of any of these SNPs, and compositions and methods based on these SNP haplotypes, combinations of SNPs, and individual SNPs, particularly methods related to psoriasis or related pathologies (e.g., Crohn's disease).

In further exemplary embodiments, the invention provides any of the SNPs in Table 11, including each of these SNPs individually as well as any combination of any of these SNPs, and compositions and methods based on these SNPs in Table 11 (including any of the SNPs individually as well as combinations thereof), particularly methods related to psoriasis or related pathologies (e.g., Crohn's disease). In certain embodiments, the SNP(s) include at least one of rs1422878, rs6861600, and/or rs3212227.

In further exemplary embodiments, the invention provides haplotypes consisting of, consisting essentially of, and comprising the 23 IL23R region SNPs rs7530511, rs10489629, rs4655692, rs2201841, rs11465804, rs10489628, rs1343152, rs10789229, rs10889671, rs11209026, rs10889674, rs12085634, rs1343151, rs1008193, rs6693831, rs10889675, rs11465827, rs10889677, rs4655531, rs11209030, rs1857292, rs11209031, and rs11209032 (Table 7) (as well as haplotypes consisting of, consisting essentially of, and comprising the twelve IL23R region SNPs rs2201841, rs10489628, 10889674, rs12085634, rs1008193, rs10889675, rs11465827, rs10889677, rs4655531, rs11209030, rs11209031, and rs11209032 (Table 8); haplotypes consisting of, consisting essentially of, and comprising the five IL23R region SNPs rs7530511, rs11465804, rs10889671, rs11209026, and rs1857292 (Table 5); and haplotypes consisting of, consisting essentially of, and comprising the three IL23R region SNPs rs7530511, rs10889671, and rs11209026 (Table 6), as well as each of these SNPs individually, any combination of any of these SNPs, and compositions and methods based on these SNP haplotypes, combinations of SNPs, and individual SNPs, particularly methods related to psoriasis or related pathologies (e.g., Crohn's disease).

In further exemplary embodiments, the invention provides methods for diagnosis of psoriasis and related pathologies by detecting one or more SNPs or SNP haplotypes disclosed herein, including, for example, detecting the presence or absence of any of the alleles of any of the SNPs that make up the haplotypes disclosed herein. In further exemplary embodiments, the invention provides methods for identifying an individual having an altered (either increased or decreased) risk for developing psoriasis and related pathologies by detecting one or more SNPs or SNP haplotypes disclosed herein, including, for example, detecting the presence or absence of any of the alleles of any of the SNPs that make up the haplotypes disclosed herein. Thus, methods are provided for determining an individual's risk for developing psoriasis and related pathologies, among other uses, using the SNPs and SNP haplotypes disclosed herein (including any combination of any of these SNPs, as well as any of these SNPs in combination with other polymorphisms).

Certain exemplary haplotypes of the invention consist of, consist essentially of, or comprise the IL12B region SNP allele combination of rs2546892 (G), rs1433048 (A), rs6894567 (G), rs17860508 (C), rs7709212 (C), rs953861 (A), rs6869411 (T), rs1833754 (T), and rs6861600 (G), particularly as non-risk haplotypes (which may be interchangeably referred to herein as "protective" haplotypes), as shown in Table 9. Certain other exemplary haplotypes of the invention consist of, consist essentially of, or comprise the IL12B region SNP allele combination of rs1368437 (C), rs2082412 (A), rs7730390 (C), rs3181225 (G), rs1368439

(T), rs3212227 (G), rs3213120 (C), rs3213119 (G), and rs2853696 (C), particularly as non-risk (protective) haplotypes, as shown in Table 10.

Certain other exemplary haplotypes of the invention consist of, consist essentially of, or comprise any of the following two combinations of IL12B region SNP alleles, particularly as risk haplotypes (which may be interchangeably referred to herein as a "susceptibility" haplotypes), as shown in Table 10:

1) rs1368437 (C), rs2082412 (G), rs7730390 (T), rs3181225 (G), rs1368439 (G), rs3212227 (T), rs3213120 (C), rs3213119 (G), and rs2853696 (T); and 2) rs1368437 (G), rs2082412 (G), rs7730390 (T), rs3181225 (G), rs1368439 (T), rs3212227 (T), rs3213120 (C), rs3213119 (G), and rs2853696 (C).

Other exemplary haplotypes of the invention consist of, consist essentially of, or comprise any of the following three combinations of IL12B region SNP alleles, as shown in Table 10:

1) rs1368437 (G), rs2082412 (G), rs7730390 (T), rs3181225 (G), rs1368439 (T), rs3212227 (T), rs3213120 (T), rs3213119 (T), and rs2853696 (C);

2) rs1368437 (C), rs2082412 (G), rs7730390 (T), rs3181225 (A), rs1368439 (T), rs3212227 (T), rs3213120 (C), rs3213119 (G), and rs2853696 (C); and 3) rs1368437 (C), rs2082412 (G), rs7730390 (T), rs3181225 (G), rs1368439 (T), rs3212227 (T), rs3213120 (C), rs3213119 (G), and rs2853696 (C).

Certain other exemplary haplotypes of the invention consist of, consist essentially of, or comprise the IL23R region SNP allele combination of rs7530511 (T), rs11465804 (T), rs10889671 (A), rs11209026 (G), and rs1857292 (T), particularly as non-risk (protective) haplotypes, as shown in Table 5. Certain other exemplary haplotypes of the invention consist of, consist essentially of, or comprise the IL23R region SNP allele combination of rs7530511 (C), rs11465804 (G), rs10889671 (G), rs11209026 (A), and rs1857292 (A), particularly as non-risk (protective) haplotypes, as shown in Table 5. Certain other exemplary haplotypes of the invention consist of, consist essentially of, or comprise the IL23R region SNP allele combination of rs7530511 (C), rs11465804 (T), rs10889671 (G), rs11209026 (G), and rs1857292 (A), particularly as risk (susceptibility) haplotypes, as shown in Table 5. Certain other exemplary haplotypes of the invention consist of, consist essentially of, or comprise any of the IL23R region SNP allele combinations shown in Table 5.

Certain other exemplary haplotypes of the invention consist of, consist essentially of, or comprise the IL23R region SNP allele combination of rs7530511 (T), rs10889671 (A), and rs11209026 (G), particularly as non-risk (protective) haplotypes, as shown in Table 6. Certain other exemplary haplotypes of the invention consist of, consist essentially of, or comprise the IL23R region SNP allele combination of rs7530511 (C), rs10889671 (G), and rs11209026 (A), particularly as non-risk (protective) haplotypes, as shown in Table 6. Certain other exemplary haplotypes of the invention consist of, consist essentially of, or comprise the IL23R region SNP allele combination of rs7530511 (C), rs10889671 (G), and rs11209026 (G), particularly as risk (susceptibility) haplotypes, as shown in Table 6.

Certain other exemplary haplotypes of the invention consist of, consist essentially of, or comprise the IL23R region SNP allele combination of rs7530511 (T), rs10489629 (T), rs4655692 (A), rs2201841 (A), rs11465804 (T), rs10489628 (G), rs1343152 (A), rs10789229 (C), rs10889671 (A), rs11209026 (G), rs10889674 (T), rs12085634 (T), rs1343151 (G), rs1008193 (C), rs6693831 (T), rs10889675 (C), rs11465827 (T), rs10889677 (C), rs4655531 (C), rs11209030 (C), rs1857292 (T), rs11209031 (A), and rs11209032 (G), particularly as non-risk (protective) haplotypes, as shown in Table 7. Certain other exemplary haplotypes of the invention consist of, consist essentially of, or comprise the IL23R region SNP allele combination of rs7530511 (C), rs10489629 (C), rs4655692 (G), rs2201841 (A), rs11465804 (G), rs10489628 (G), rs1343152 (C), rs10789229 (T), rs10889671 (G), rs11209026 (A), rs10889674 (T), rs12085634 (T), rs1343151 (A), rs1008193 (C), rs6693831 (C), rs10889675 (C), rs11465827 (T), rs10889677 (C), rs4655531 (C), rs11209030 (C), rs1857292 (A), rs11209031 (A), and rs11209032 (G), particularly as non-risk (protective) haplotypes, as shown in Table 7. Certain other exemplary haplotypes of the invention consist of, consist essentially of, or comprise any of the IL23R region SNP allele combinations shown in Table 7.

Certain other exemplary haplotypes of the invention consist of, consist essentially of, or comprise the IL23R region SNP allele combination of rs2201841 (A), rs10489628 (G), 10889674 (T), rs12085634 (T), rs1008193 (C), rs10889675 (C), rs11465827 (T), rs10889677 (C), rs4655531 (C), rs11209030 (C), rs11209031 (A), and rs11209032 (G), particularly as non-risk (protective) haplotypes, as shown in Table 8. Certain other exemplary haplotypes of the invention consist of, consist essentially of, or comprise the IL23R region SNP allele combination of rs2201841 (G), rs10489628 (G), 10889674 (G), rs12085634 (T), rs1008193 (C), rs10889675 (C), rs11465827 (T), rs10889677 (A), rs4655531 (C), rs11209030 (C), rs11209031 (A), and rs11209032 (A), particularly as risk (susceptibility) haplotypes, as shown in Table 8. Certain other exemplary haplotypes of the invention consist of, consist essentially of, or comprise the IL23R region SNP allele combination of rs2201841 (A), rs10489628 (G), 10889674 (G), rs12085634 (A), rs1008193 (C), rs10889675 (C), rs11465827 (T), rs10889677 (C), rs4655531 (C), rs11209030 (C), rs11209031 (A), and rs11209032 (G), particularly as risk (susceptibility) haplotypes, as shown in Table 8. Certain other exemplary haplotypes of the invention consist of, consist essentially of, or comprise any of the IL23R region SNP allele combinations shown in Table 8.

Furthermore, certain exemplary embodiments of the invention provide methods for identifying an individual having an increased risk of developing psoriasis by detecting one or more haplotypes, particularly an IL12B region haplotype selected from the group consisting of the following two risk haplotypes:

1) rs1368437 (C), rs2082412 (G), rs7730390 (T), rs3181225 (G), rs1368439 (G), rs3212227 (T), rs3213120 (C), rs3213119 (G), and rs2853696 (T) (see Table 10); and 2) rs1368437 (G), rs2082412 (G), rs7730390 (T), rs3181225 (G), rs1368439 (T), rs3212227 (T), rs3213120 (C), rs3213119 (G), and rs2853696 (C) (see Table 10).

Alternative exemplary embodiment of the invention provide methods for identifying individuals having a decreased risk of developing psoriasis (particularly as compared to the risk of developing psoriasis for the IL12B risk haplotypes above) by detecting one or more haplotypes, particularly an IL12B region haplotype selected from the group consisting of the following two non-risk (protective) haplotypes:

1) rs2546892 (G), rs1433048 (A), rs6894567 (G), rs17860508 (C), rs7709212 (C), rs953861 (A), rs6869411 (T), rs1833754 (T), and rs6861600 (G) (see Table 9); and 2) rs1368437 (C), rs2082412 (A), rs7730390 (C), rs3181225 (G), rs1368439 (T), rs3212227 (G), rs3213120 (C), rs3213119 (G), and rs2853696 (C) (see Table 10).

Alternative exemplary embodiment of the invention provide methods for identifying individuals having an increased risk of developing psoriasis by detecting one or more haplotypes, particularly an IL23R region haplotype selected from the group consisting of the following four risk (susceptibility) haplotypes:

1) rs7530511 (C), rs11465804 (T), rs10889671 (G), rs11209026 (G), and rs1857292 (A) (see Table 5);

2) rs7530511 (C), rs10889671 (G), and rs11209026 (G) (see Table 6);

3) rs2201841 (G), rs10489628 (G), 10889674 (G), rs12085634 (T), rs1008193 (C), rs10889675 (C), rs11465827 (T), rs10889677 (A), rs4655531 (C), rs11209030 (C), rs11209031 (A), and rs11209032 (A) (see Table 8); and 4) rs2201841 (A), rs10489628 (G), 10889674 (G), rs12085634 (A), rs1008193 (C), rs10889675 (C), rs11465827 (T), rs10889677 (C), rs4655531 (C), rs11209030 (C), rs11209031 (A), and rs11209032 (G) (see Table 8).

Alternative exemplary embodiment of the invention provide methods for identifying individuals having a decreased risk of developing psoriasis (particularly as compared to the risk of developing psoriasis for the IL23R risk haplotypes above) by detecting one or more haplotypes, particularly an IL23R region haplotype selected from the group consisting of the following seven non-risk (protective) haplotypes:

1) rs7530511 (T), rs11465804 (T), rs10889671 (A), rs11209026 (G), and rs1857292 (T) (see Table 5)

2) rs7530511 (C), rs11465804 (G), rs10889671 (G), rs11209026 (A), and rs1857292 (A) (see Table 5)

3) rs7530511 (T), rs10889671 (A), and rs11209026 (G) (see Table 6)

4) rs7530511 (C), rs10889671 (G), and rs11209026 (A) (see Table 6)

5) rs7530511 (T), rs10489629 (T), rs4655692 (A), rs2201841 (A), rs11465804 (T), rs10489628 (G), rs1343152 (A), rs10789229 (C), rs10889671 (A), rs11209026 (G), rs10889674 (T), rs12085634 (T), rs1343151 (G), rs1008193 (C), rs6693831 (T), rs10889675 (C), rs11465827 (T), rs10889677 (C), rs4655531 (C), rs11209030 (C), rs1857292 (T), rs11209031 (A), and rs11209032 (G) (see Table 7)

6) rs7530511 (C), rs10489629 (C), rs4655692 (G), rs2201841 (A), rs11465804 (G), rs10489628 (G), rs1343152 (C), rs10789229 (T), rs10889671 (G), rs11209026 (A), rs10889674 (T), rs12085634 (T), rs1343151 (A), rs1008193 (C), rs6693831 (C), rs10889675 (C), rs11465827 (T), rs10889677 (C), rs4655531 (C), rs11209030 (C), rs1857292 (A), rs11209031 (A), and rs11209032 (G) (see Table 7); and 7) rs2201841 (A), rs10489628 (G), 10889674 (T), rs12085634 (T), rs1008193 (C), rs10889675 (C), rs11465827 (T), rs10889677 (C), rs4655531 (C), rs11209030 (C), rs11209031 (A), and rs11209032 (G) (see Table 8).

The SNPs and haplotypes provided herein can be combined with other genetic variants, such as to increase the power to determine psoriasis risk. For example, the SNPs and haplotypes provided herein can be combined with any of the SNPs and haplotypes disclosed in U.S. patent application Ser. No. 11/899,017, filed Aug. 31, 2007 (Begovich et al.), and Cargill et al., "A large-scale genetic association study confirms IL12B and leads to the identification of IL23R as psoriasis risk genes", *Am J Hum Genet.* 2007 February; 80(2):273-90, both of which are incorporated herein by reference in their entirety.

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment or prevention of psoriasis.

An aspect of this invention is a method for treating or preventing psoriasis (including, for example, a first occurrence and/or a recurrence of the disease), in a human subject wherein said human subject harbors a SNP, gene, transcript, and/or encoded protein identified in Tables 1 and 2, which method comprises administering to said human subject a therapeutically or prophylactically effective amount of one or more agents counteracting the effects of the disease, such as by inhibiting (or stimulating) the activity of a gene, transcript, and/or encoded protein identified in Tables 1 and 2.

Another aspect of this invention is a method for identifying an agent useful in therapeutically or prophylactically treating psoriasis, in a human subject wherein said human subject harbors a SNP, gene, transcript, and/or encoded protein identified in Tables 1 and 2, which method comprises contacting the gene, transcript, or encoded protein with a candidate agent under conditions suitable to allow formation of a binding complex between the gene, transcript, or encoded protein and the candidate agent and detecting the formation of the binding complex, wherein the presence of the complex identifies said agent.

Another aspect of this invention is a method for treating or preventing psoriasis in a human subject, in which the method comprises:

(i) determining that said human subject harbors a SNP, gene, transcript, and/or encoded protein identified in Tables 1 and 2, and (ii) administering to said subject a therapeutically or prophylactically effective amount of one or more agents counteracting the effects of the disease.

Another aspect of the invention is a method for identifying a human who is likely to benefit from a drug treatment, in which the method comprises detecting an allele of one or more SNPs disclosed herein in said human's nucleic acids, wherein the presence of the allele indicates that said human is likely to benefit from the drug treatment.

Another aspect of the invention is a method for identifying a human who is likely to benefit from a drug treatment, in which the method comprises detecting an allele of one or more SNPs that are in LD with one or more SNPs disclosed herein in said human's nucleic acids, wherein the presence of the allele of the LD SNP indicates that said human is likely to benefit from the drug treatment.

Many other uses and advantages of the present invention will be apparent to those skilled in the art upon review of the detailed description of the preferred embodiments herein. Solely for clarity of discussion, the invention is described in the sections below by way of non-limiting examples.

Description of the Text (ASCII) File Submitted Electronically Via EFS-Web

The following text (ASCII) file is submitted electronically via EFS-Web as part of the instant application:

File CD000025ORD_SEQLIST.txt provides the Sequence Listing. The Sequence Listing provides the transcript sequences (SEQ ID NOS:1-2) and protein sequences (SEQ ID NOS:3-4) as referred to in Table 1, and genomic sequences (SEQ ID NOS:13-20) as referred to in Table 2, for each psoriasis-associated gene (or genomic region for intergenic SNPs) that contains one or more SNPs of the present invention. Also provided in the Sequence Listing are context sequences flanking each SNP, including both transcript-based context sequences as referred to in Table 1 (SEQ ID NOS:5-12) and genomic-based context sequences as referred to in Table 2 (SEQ ID NOS:21-307). In addition, the Sequence Listing provides the primer sequences from Table 3 (SEQ ID NOS:308-541), which are oligonucleotides that have been synthesized and used in the laboratory to assay certain SNPs disclosed herein by allele-specific PCR during the course of association studies to verify the association of these SNPs with psoriasis. The context sequences generally provide 100 bp upstream (5') and 100 bp downstream (3') of each SNP, with the SNP in the middle of the context sequence, for a total of 200 bp of context sequence surrounding each SNP.

File CD000025ORD_SEQLIST.txt is 978 KB in size, and was created on Jun. 23, 2009.

This text file is hereby incorporated by reference pursuant to 37 CFR 1.77(b)(4).

Description of Table 1 and Table 2

Table 1 and Table 2 (both provided below) disclose the SNP and associated gene/transcript/protein information of the present invention. For each gene, Table 1 provides a header containing gene, transcript and protein information, followed by a transcript and protein sequence identifier (SEQ ID NO), and then SNP information regarding each SNP found in that gene/transcript including the transcript context sequence. For each gene in Table 2, a header is provided that contains gene and genomic information, followed by a genomic sequence identifier (SEQ ID NO) and then SNP information regarding each SNP found in that gene, including the genomic context sequence.

Note that SNP markers may be included in both Table 1 and Table 2; Table 1 presents the SNPs relative to their transcript sequences and encoded protein sequences, whereas Table 2 presents the SNPs relative to their genomic sequences. In some instances Table 2 may also include, after the last gene sequence, genomic sequences of one or more intergenic regions, as well as SNP context sequences and other SNP information for any SNPs that lie within these intergenic regions. Additionally, in either Table 1 or 2 a "Related Interrogated SNP" may be listed following a SNP which is determined to be in LD with that interrogated SNP according to the given Power value. SNPs can be readily cross-referenced between all Tables based on their Celera hCV (or, in some instances, hDV) identification numbers and/or public rs identification numbers, and to the Sequence Listing based on their corresponding SEQ ID NOs.

The gene/transcript/protein information includes:
a gene number (1 through n, where n=the total number of genes in the Table),
a gene symbol, along with an Entrez gene identification number (Entrez Gene database, National Center for Biotechnology Information (NCBI), National Library of Medicine, National Institutes of Health)
a gene name,
an accession number for the transcript (e.g., RefSeq NM number, or a Celera hCT identification number if no RefSeq NM number is available) (Table 1 only),
an accession number for the protein (e.g., RefSeq NP number, or a Celera hCP identification number if no RefSeq NP number is available) (Table 1 only),
the chromosome number of the chromosome on which the gene is located,
an OMIM ("Online Mendelian Inheritance in Man" database, Johns Hopkins University/NCBI) public reference number for the gene, and OMIM information such as alternative gene/protein name(s) and/or symbol(s) in the OMIM entry.

Note that, due to the presence of alternative splice forms, multiple transcript/protein entries may be provided for a single gene entry in Table 1; i.e., for a single Gene Number, multiple entries may be provided in series that differ in their transcript/protein information and sequences.

Following the gene/transcript/protein information is a transcript context sequence (Table 1), or a genomic context sequence (Table 2), for each SNP within that gene.

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (such SNPs are identified as "INTERGENIC" for SNP type).

Note that the transcript, protein, and transcript-based SNP context sequences are all provided in the Sequence Listing. The transcript-based SNP context sequences are provided in both Table 1 and also in the Sequence Listing. The genomic and genomic-based SNP context sequences are provided in the Sequence Listing. The genomic-based SNP context sequences are provided in both Table 2 and in the Sequence Listing. SEQ ID NOs are indicated in Table 1 for the transcript-based context sequences (SEQ ID NOS:5-12); SEQ ID NOs are indicated in Table 2 for the genomic-based context sequences (SEQ ID NOS:21-307).

The SNP information includes:
Context sequence (taken from the transcript sequence in Table 1, the genomic sequence in Table 2) with the SNP represented by its IUB code, including 100 bp upstream (5') of the SNP position plus 100 bp downstream (3') of the SNP position (the transcript-based SNP context sequences in Table 1 are provided in the Sequence Listing as SEQ ID NOS:5-12; the genomic-based SNP context sequences in Table 2 are provided in the Sequence Listing as SEQ ID NOS:21-307).
Celera hCV internal identification number for the SNP (in some instances, an "hDV" number is given instead of an "hCV" number).
The corresponding public identification number for the SNP, the rs number.
"SNP Chromosome Position" indicates the nucleotide position of the SNP along the entire sequence of the chromosome as provided in NCBI Genome Build 36.
SNP position (nucleotide position of the SNP within the given transcript sequence (Table 1) or within the given genomic sequence (Table 2)).
"Related Interrogated SNP" is the interrogated SNP with which the listed SNP is in LD at the given value of Power.
SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have a disease, "dbSNP"=SNP observed in the dbSNP public database, "HGBASE"=SNP observed in the HGBASE public database, "HGMD"=SNP observed in the Human Gene Mutation Database (HGMD) public database, "HapMap"=SNP observed in the International HapMap Project public database, "CSNP"=SNP observed in an internal Applied Biosystems (Foster City, Calif.) database of coding SNPS (cSNPs).

Note that multiple "Applera" source entries for a single SNP indicate that the same SNP was covered by multiple overlapping amplification products and the re-sequencing results (e.g., observed allele counts) from each of these amplification products is being provided.

Population/allele/allele count information in the format of [population1(first_allele,count|second_allele,count) population2(first_allele,count|second_allele,coun t) total (first_allele,total count|second_allele,total count)]. The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain"="American Indian, "cra"=Celera donor, "no_pop"=no population information available), identified SNP alleles, and observed allele counts (within each population group and total allele counts), where available ["–" in the allele field represents a deletion allele of an insertion/deletion ("indel") polymorphism (in which case the corresponding insertion allele, which may be comprised of one or more nucleotides, is indicated in the allele field on the opposite side of the "|"); "–" in the count field indicates that allele count information is not available]. For certain SNPs from the public dbSNP database, population/ethnic information is indicated as follows (this population information is publicly available in dbSNP): "HISP1"=human individual DNA (anonymized samples) from 23 individuals of self-described HISPANIC heritage; "PAC1"=human individual DNA (anonymized samples) from 24 individuals of self-described PACIFIC RIM heritage; "CAUL 1"=human individual DNA (anonymized samples) from 31 individuals of self-described CAUCASIAN heritage; "AFR1"=human individual DNA (anonymized samples) from 24 individuals of self-described AFRICAN/AFRICAN AMERICAN heritage; "P1"=human individual DNA (anonymized samples) from 102 individuals of self-described heritage; "PA130299515"; "SC_12_A"=SANGER 12 DNAs of Asian origin from Corielle cell repositories, 6 of which are male and 6 female; "SC_12_C"=SANGER 12 DNAs of Caucasian origin from Corielle cell repositories from the CEPH/UTAH library, six male and six female; "SC_12_AA"=SANGER 12 DNAs of African-American origin from Corielle cell repositories 6 of which are male and 6 female; "SC_95_C"=SANGER 95 DNAs of Caucasian origin from Corielle cell repositories from the CEPH/UTAH library; and "SC_12_CA"=Caucasians—12 DNAs from Corielle cell repositories that are from the CEPH/UTAH library, six male and six female.

Note that for SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

Note that semicolons separate population/allele/count information corresponding to each indicated SNP source; i.e., if four SNP sources are indicated, such as "Celera," "dbSNP," "HGBASE," and "HGMD," then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information.

SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5" =SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary].

Protein coding information (Table 1 only), where relevant, in the format of [protein SEQ ID NO, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Description of Table 3

Table 3 provides sequences (SEQ ID NOS:308-541) of primers that may be used to assay the SNPs disclosed herein by allele-specific PCR or other methods, such as for uses related to psoriasis and other autoinflammatory diseases.

Table 3 provides the following:

the column labeled "Marker" provides an hCV identification number for each SNP that can be detected using the corresponding primers.

the column labeled "Alleles" designates the two alternative alleles (i.e., nucleotides) at the SNP site. These alleles are targeted by the allele-specific primers (the allele-specific primers are shown as Primer 1 and Primer 2). Note that alleles may be presented in Table 3 based on a different orientation (i.e., the reverse complement) relative to how the same alleles are presented in Tables 1-2.

the column labeled "Primer 1 (Allele-Specific Primer)" provides an allele-specific primer that is specific for an allele designated in the "Alleles" column.

the column labeled "Primer 2 (Allele-Specific Primer)" provides an allele-specific primer that is specific for the other allele designated in the "Alleles" column.

the column labeled "Common Primer" provides a common primer that is used in conjunction with each of the allele-specific primers (i.e., Primer 1 and Primer 2) and which hybridizes at a site away from the SNP position.

All primer sequences are given in the 5' to 3' direction.

Each of the nucleotides designated in the "Alleles" column matches or is the reverse complement of (depending on the orientation of the primer relative to the designated allele) the 3' nucleotide of the allele-specific primer (i.e., either Primer 1 or Primer 2) that is specific for that allele.

Description of Table 4

Table 4 provides a list of LD SNPs that are related to and derived from certain interrogated SNPs. The interrogated SNPs, which are shown in column 1 (which indicates the hCV identification numbers of each interrogated SNP) and column 2 (which indicates the public rs identification numbers of each interrogated SNP) of Table 4, are statistically significantly associated with psoriasis, as described and shown herein, particularly in Tables 5-11 and in the Examples section below. The LD SNPs are provided as an example of SNPs which can also serve as markers for disease association based on their being in LD with an interrogated SNP. The criteria and process of selecting such LD SNPs, including the calculation of the $r^2$ value and the $r^2$ threshold value, are described in Example 3, below.

In Table 4, the column labeled "Interrogated SNP" presents each marker as identified by its unique hCV identification number. The column labeled "Interrogated rs" presents the publicly known rs identification number for the corresponding hCV number. The column labeled "LD SNP" presents the hCV numbers of the LD SNPs that are derived from their corresponding interrogated SNPs. The column labeled "LD SNP rs" presents the publicly known rs identification number for the corresponding hCV number. The column labeled "Power" presents the level of power where the $r^2$ threshold is set. For example, when power is set at 0.51, the threshold $r^2$ value calculated therefrom is the minimum $r^2$ that an LD SNP must have in reference to an interrogated SNP, in order for the LD SNP to be classified as a marker capable of being associated with a disease phenotype at greater than 51% probability. The column labeled "Threshold $r^2$" presents the minimum value of $r^2$ that an LD SNP must meet in reference to an interrogated SNP in order to qualify as an LD SNP. The column labeled "$r^2$" presents the actual $r^2$ value of the LD SNP in reference to the interrogated SNP to which it is related.

Description of Tables 5-11

Tables 5-11 provide the results of statistical analyses for SNPs disclosed in Tables 1 and 2 (SNPs can be cross-referenced between all the tables herein based on their hCV and/or rs identification numbers). The results shown in Tables 5-11 provide support for the association of these SNPs with psoriasis.

Tables 5-8 are further described in Example 1 below (identification and analysis of haplotypes in the IL23R region associated with psoriasis).

Table 5 provides information for haplotypes based on the following 5 IL23R region SNPs: rs7530511, rs11465804, rs10889671, rs11209026, and rs1857292. For the psoriasis risk (susceptibility) haplotype rs7530511 (C), rs11465804 (T), rs10889671 (G), rs11209026 (G), rs1857292 (A), the naive odds ratio (OR) was 1.391 ($P_{comb}$=0.000000648). For the psoriasis non-risk (protective) haplotype rs7530511 (T), rs11465804 (T), rs10889671 (A), rs11209026 (G), rs1857292 (T), the naive odds ratio (OR) was 0.752 ($P_{comb}$=0.00356). For the psoriasis non-risk (protective) haplotype rs7530511 (C), rs11465804 (G), rs10889671 (G), rs11209026 (A), rs1857292 (A), the naive odds ratio (OR) was 0.599 ($P_{comb}$=0.0000399).

Table 6 provides information for haplotypes based on the following 3 IL23R region SNPs: rs7530511, rs10889671, and rs11209026. For the psoriasis risk (susceptibility) haplotype rs7530511 (C), rs10889671 (G), rs112090 (G), the naive odds ratio (OR) was 1.436 ($P_{comb}$=0.000000384). For the psoriasis non-risk (protective) haplotype rs7530511 (T), rs10889671 (A), rs112090 (G), the naive odds ratio (OR) was 0.757 ($P_{comb}$=0.0012). For the psoriasis non-risk (protective) haplotype rs7530511 (C), rs10889671 (G), rs112090 (A), the naive odds ratio (OR) was 0.588 ($P_{comb}$=0.00000974).

Table 7 provides information for haplotypes based on the following 23 IL23R region SNPs: rs7530511, rs10489629, rs4655692, rs2201841, rs11465804, rs10489628, rs1343152, rs10789229, rs10889671, rs11209026, rs10889674, rs12085634, rs1343151, rs1008193, rs6693831, rs10889675, rs11465827, rs10889677, rs4655531, rs11209030, rs1857292, rs11209031, and rs11209032.

Table 8 provides information for haplotypes based on the following 12 IL23R region SNPs: rs2201841, rs10489628, 10889674, rs12085634, rs1008193, rs10889675, rs11465827, rs10889677, rs4655531, rs11209030, rs11209031, and rs11209032.

Tables 9-11 are further described in Example 2 below (identification and analysis of haplotypes and individual SNPs in the IL12B region associated with psoriasis).

Table 9 provides information for haplotypes based on the following 9 IL12B region SNPs: rs2546892, rs1433048, rs6894567, rs17860508, rs7709212, rs953861, rs6869411, rs1833754, and rs6861600.

Table 10 provides information for haplotypes based on the following 9 IL12B region SNPs: rs1368437, rs2082412, rs7730390, rs3181225, rs1368439, rs3212227, rs3213120, rs3213119, and rs2853696.

Table 11 provides 105 SNPs in the IL12B region that have been identified as being associated with psoriasis risk (p-value <0.05). In Table 11, the column labeled "Genotyped or Imputed" indicates whether the data provided for the given SNP was derived from genotyping of psoriasis samples or from imputation. See Example 2 below for further information regarding Table 11.

Tables 5 and 6 indicate case and control counts, with case and control frequencies in parentheses. Tables 9 and 10 indicate case and control frequencies, with case and control counts in parentheses. Table 7 only indicates case and control counts (not frequencies). Table 8 only indicates case and control counts in the upper portion of the table, and only indicates case and control frequencies in the lower portion of the table. Table 11 indicates case and control frequencies.

In Tables 9 and 10, each of the nine nucleotides of each haplotype respectively correspond to each of the nine SNPs listed in the column labeled "SNP set".

In Tables 9 and 10, "S0048", "S0056A", and "A0019" indicate independent sample sets (i.e., study populations). Specifically, "S0048", "S0056A", and "A0019" correspond to "Sample Set 1", "Sample Set 2", and "Sample Set 3", respectively, which are described below in Example 1.

Throughout Tables 5-11, "P", "P-value", or "Hap.P" refers to the p-value for the given haplotype (or individual SNP in Table 11).

In Tables 5-6 and 9-10, "Comb P" or $P_{comb}$ refers to p-values across independent studies (sample sets).

In Tables 9 and 10, "Global" refers to p-values for all haplotypes combined together within a study (sample set), and "Global Comb P" refers to the p-value for all haplotypes combined together across independent studies (sample sets).

In Table 10, "Other" refers to other haplotypes not listed.

Throughout Tables 5-11, "OR" refers to the odds ratio ("OR95l" and "OR95u" in Table 11 refer to the lower and upper 95% confidence intervals, respectively, for the odds ratio). Odds ratios (OR) that are greater than one indicate that a given allele or haplotype is a risk allele/haplotype associated with an increased risk for a given disease such as psoriasis (which may also be referred to as a "susceptibility" allele/haplotype), whereas odds ratios that are less than one indicate that a given allele or haplotype is a non-risk allele/haplotype associated with a decreased risk for a given disease such as psoriasis (which may also be referred to as a "protective" allele/haplotype), particularly as compared to the disease risk for the risk allele/haplotype. For a given risk allele, the other alternative allele at the SNP position (which can be derived from the information provided in Tables 1-2, for example) may be considered a non-risk allele. For a given non-risk allele, the other alternative allele at the SNP position may be considered a risk allele.

Thus, with respect to disease risk (e.g., psoriasis), if the risk estimate (odds ratio or hazard ratio) for a particular allele at a SNP position is greater than one, this indicates that an individual with this particular allele has a higher risk for the disease than an individual who has the other allele at the SNP position. In contrast, if the risk estimate (odds ratio or hazard ratio) for a particular allele is less than one, this indicates that an individual with this particular allele has a reduced risk for the disease compared with an individual who has the other allele at the SNP position.

With respect to drug response (e.g., response to an anti-IL12 and/or an anti-IL23 therapy), if the risk estimate (odds ratio or hazard ratio) of those treated with the drug (e.g., an anti-IL12 and/or an anti-IL23 antibody) compared with those treated with a placebo within a particular genotype is less than one, this indicates that an individual with this particular genotype would benefit from the drug (an odds ratio or hazard ratio equal to one would indicate that the drug has no effect). As used herein, the term "benefit" (with respect to a preventive or therapeutic drug treatment) is defined as achieving a reduced risk for a disease that the drug is intended to treat or prevent (e.g., psoriasis or a related pathology such as Crohn's disease) by administrating the drug treatment, compared with the risk for the disease in the absence of receiving the drug treatment (or receiving a placebo in lieu of the drug treatment) for the same genotype.

DETAILED DESCRIPTION OF THE INVENTION

The present invention provides SNPs associated with autoinflammatory diseases such as psoriasis. The present invention further provides nucleic acid molecules containing these SNPs, methods and reagents for the detection of the SNPs disclosed herein, uses of these SNPs for the development of detection reagents, and assays or kits that utilize such reagents. The SNPs disclosed herein are useful for diagnosing, prognosing, screening for, and evaluating predisposition to psoriasis and related pathologies (e.g., Crohn's disease and other autoinflammatory diseases) in humans, as well as for predicting an individual's responsiveness to therapies used to treat psoriasis and related pathologies. Furthermore, such SNPs and their encoded products are useful targets for the development of therapeutic and preventive agents.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during "shotgun" sequencing and assembly of the human genome, and they are indicated as "Celera" SNP source in Tables 1 and 2. Furthermore, the information provided in Tables 1 and 2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with psoriasis, as well as combinations of SNPs and haplotypes, polymorphic/variant transcript sequences (SEQ ID NOS:1-2) and genomic sequences (SEQ ID NOS: 13-20) containing SNPs, encoded amino acid sequences (SEQ ID NOS:3-4), and both transcript-based SNP context sequences (SEQ ID NOS:5-12) and genomic-based SNP context sequences (SEQ ID NOS:21-307) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having or developing psoriasis, methods of determining if an individual is likely to respond to a particular treatment (particularly for treating or preventing psoriasis), methods of screening for compounds useful for treating disorders associated with a variant gene/protein such as psoriasis, compounds identified by these screening methods, methods of using the disclosed SNPs to select a treatment/preventive strategy or therapeutic agent, methods of treating or preventing a disorder associated with a variant gene/protein, and methods of using the SNPs of the present invention for human identification.

The present invention further provides methods for selecting or formulating a treatment regimen (e.g., methods for determining whether or not to administer treatment to an individual having psoriasis, or who is at risk for developing psoriasis in the future, or who has previously had psoriasis, methods for selecting a particular treatment regimen such as dosage and frequency of administration, or a particular form/type of drug such as a particular pharmaceutical formulation or compound, etc.), and methods for determining the likelihood of experiencing toxicity or other undesirable side effects from a drug treatment, etc. The present invention also provides methods for selecting individuals to whom a therapeutic agent will be administered based on the individual's genotype, and methods for selecting individuals for a clinical trial of a therapeutic agent based on the genotypes of the individuals (e.g., selecting individuals to participate in the trial who are most likely to respond positively from the drug treatment and/or excluding individuals from the trial who are unlikely to respond positively from the drug treatment based on their SNP genotype(s), or selecting individuals who are unlikely to respond positively to a particular drug based on their SNP genotype(s) to participate in a clinical trial of another type of drug that may benefit them).

The present invention provides novel SNPs associated with psoriasis, as well as SNPs that were previously known in the art, but were not previously known to be associated with psoriasis. Accordingly, the present invention provides novel compositions and methods based on the novel SNPs disclosed herein, and also provides novel methods of using the known, but previously unassociated, SNPs in methods relating to evaluating an individual's likelihood of having or developing psoriasis, predicting the likelihood of an individual experiencing a reccurrence of psoriasis, prognosing the severity of psoriasis in an individual, or prognosing an individual's recovery from psoriasis, and methods relating to evaluating an individual's likelihood of responding to a drug treatment. In Tables 1 and 2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD).

Particular SNP alleles of the present invention can be associated with either an increased risk of having or developing psoriasis or increased likelihood of responding to a drug treatment, or a decreased risk of having or developing psoriasis or decreased likelihood of responding to a drug treatment. Thus, whereas certain SNPs (or their encoded products) can be assayed to determine whether an individual possesses a SNP allele that is indicative of an increased risk of having or developing psoriasis or increased likelihood of responding to a drug treatment, other SNPs (or their encoded products) can be assayed to determine whether an individual possesses a SNP allele that is indicative of a decreased risk of having or developing psoriasis or decreased likelihood of responding to a drug treatment. Similarly, particular SNP alleles of the present invention can be associated with either an increased or decreased likelihood of having a reccurrence of psoriasis, of fully recovering from psoriasis, of experiencing toxic effects from a particular treatment or therapeutic compound, etc. The term "altered" may be used herein to encompass either of these two possibilities (e.g., an increased or a decreased risk/likelihood). SNP alleles that are associated with a decreased risk of having or developing psoriasis may be referred to as "protective" alleles, and SNP alleles that are associated with an increased risk of having or developing psoriasis may be referred to as "susceptibility" alleles, "risk" alleles, or "risk factors".

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type," "reference," or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation (i.e., a SNP that creates a premature stop codon, a SNP that generates a read-through mutation by abolishing a stop codon), or due to any SNP disclosed by the present invention that otherwise alters the structure, function, activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide," "peptide," and "protein" are used interchangeably.

As used herein, an "allele" may refer to a nucleotide at a SNP position (wherein at least two alternative nucleotides are present in the population at the SNP position, in accordance with the inherent definition of a SNP) or may refer to an amino acid residue that is encoded by the codon which contains the SNP position (where the alternative nucleotides that are present in the population at the SNP position form alternative codons that encode different amino acid residues). An "allele" may also be referred to herein as a "variant". Also, an amino acid residue that is encoded by a codon containing a particular SNP may simply be referred to as being encoded by the SNP.

A phrase such as "as represented by", "as shown by", "as symbolized by", or "as designated by" may be used herein to refer to a SNP within a sequence (e.g., a polynucleotide context sequence surrounding a SNP), such as in the context of "a polymorphism as represented by position 101 of SEQ ID NO:X or its complement". Typically, the sequence surrounding a SNP may be recited when referring to a SNP, however the sequence is not intended as a structural limitation beyond the specific SNP position itself. Rather, the sequence is recited merely as a way of referring to the SNP (in this example, "SEQ ID NO:X or its complement" is recited in order to refer to the SNP located at position 101 of SEQ ID NO:X, but SEQ ID NO:X or its complement is not intended as a structural limitation beyond the specific SNP position itself). In other words, it is recognized that the context sequence of SEQ ID NO:X in this example may contain one or more polymorphic nucleotide positions outside of position 101 and therefore an exact match over the full-length of SEQ ID NO:X is irrelevant since SEQ ID NO:X is only meant to provide context for referring to the SNP at position 101 of SEQ ID NO:X. Likewise, the length of the context sequence is also irrelevant (100 nucleotides on each side of a SNP position has been arbitrarily used in the present application as the length for context sequences merely for convenience and because 201 nucleotides of total length is expected to provide sufficient uniqueness to unambiguously identify a given nucleotide sequence). Thus, since a SNP is a variation at a single nucleotide position, it is customary to refer to context sequence (e.g., SEQ ID NO:X in this example) surrounding a particular SNP position in order to uniquely identify and refer to the SNP. Alternatively, a SNP can be referred to by a unique identification number such as a public "rs" identification number or an internal "hCV" identification number, such as provided herein for each SNP (e.g., in Tables 1-2).

As used herein, the term "benefit" (with respect to a preventive or therapeutic drug treatment) is defined as achieving a reduced risk for a disease that the drug is intended to treat or prevent (e.g., psoriasis) by administrating the drug treatment, compared with the risk for the disease in the absence of receiving the drug treatment (or receiving a placebo in lieu of the drug treatment) for the same genotype. The term "benefit" may be used herein interchangeably with terms such as "respond positively" or "positively respond".

As used herein, the terms "drug" and "therapeutic agent" are used interchangeably, and may include, but are not limited to, small molecule compounds, biologics (e.g., antibodies, proteins, protein fragments, fusion proteins, glycoproteins, etc.), nucleic acid agents (e.g., antisense, RNAi/siRNA, and microRNA molecules, etc.), vaccines, etc., which may be used for therapeutic and/or preventive treatment of a disease (e.g., psoriasis or Crohn's disease).

As used herein, the term "related pathologies" (e.g., in the context of "psoriasis and related pathologies") includes inflammatory and autoimmune disorders (collectively referred to herein as "autoinflammatory" diseases/disorders) such as inflammatory bowel disease (IBD) (including Crohn's disease, which further includes both adult and pediatric Crohn's disease, and ulcerative colitis) and other chronic inflammatory disorders, atopic dermatitis, multiple sclerosis, rheumatoid arthritis, ankylosing spondylitis (AS), celiac disease, Graves' disease (including Graves' ophthalmopathy (GO) and Graves' disease without opthalmopathy), and Barrett's esophagus.

In addition to autoinflammatory diseases, it is also specifically contemplated that the SNPs and haplotypes of the invention may also have utilities with respect to an individual's response to infectious diseases (e.g., mycobacterial infections such as tuberculosis and leprosy, as well as Chagas' disease cardiomyopathy and fatal cerebral malaria), as well as other disorders such as hypertension and stroke. For example, the exemplary SNPs and haplotypes of the invention may be used for determining an individual's susceptibility to these disorders (or the individual's immune response to infectious agents), as well as psoriasis, Crohn's disease, and related pathologies (such as the pathologies identified in the preceding paragraph). For the role of IL12B in hypertension and stroke, see Timasheva et al., "Association of interleukin-6, interleukin-12, and interleukin-10 gene polymorphisms with essential hypertension in Tatars from Russia", *Biochem Genet.* 2008 February; 46(1-2):64-74. For the role of IL12B in mycobacterial infections such as tuberculosis and leprosy, see Morahan et al., "Association of variants in the IL12B gene with leprosy and tuberculosis", *Tissue Antigens.* 2007 April; 69 Suppl 1:234-6. For the role of IL12B in Chagas' disease cardiomyopathy, see Zafra et al., "Polymorphism in the 3' UTR of the IL12B gene is associated with Chagas' disease cardiomyopathy", *Microbes Infect.* 2007 July; 9(9):1049-52. For the role of IL12B in fatal cerebral malaria, see Morahan et al., "A promoter polymorphism in the gene encoding interleukin-12 p40 (IL12B) is associated with mortality from cerebral malaria and with reduced nitric oxide production", Genes Immun. 2002 November; 3(7):414-8.

The following references further describe the roles of IL12B and/or IL23R in psoriasis, Crohn's disease, and other autoinflammatory diseases, as well as in response to infectious diseases: Schrodi (2008) "Genome-wide association scan in psoriasis: new insights into chronic inflammatory disease", *Expert Rev. Clin. Immunol.* 4(5); Duffin et al., "Genetic variations in cytokines and cytokine receptors associated with psoriasis found by genome-wide association", *J Invest Dermatol.* 2009 April; 129(4):827-33; Nair et al (2009) "Genome-wide scan reveals association of psoriasis with IL-23 and NF-kappaB pathways". *Nat Genet* 41(2): 199-204; Brown (2009) "Genetics and the pathogenesis of ankylosing spondylitis". *Curr Opin Rheumatol* 21(4):318-323; Elder (2009) "Genome-wide association scan yields new insights into the immunopathogenesis of psoriasis". *Genes Immun* 10(3):201-209; Abraham et al. (2009) "Interleukin-23/Th17 pathways and inflammatory bowel disease". *Inflamm Bowel Dis. Feb.* 27 [Epub]; Gee et al (2009) "The IL-12 family of cytokines in infection, inflammation and autoimmune disorders". *Inflamm Allergy Drug Targets.* 8(1): 40-52; Kauffman et al. (2004) "A Phase I study evaluating the safety, pharmacokinetics, and clinical response of a human IL-12 p40 antibody in subjects with plaque psoriasis". *J Inv Dermat* 123:1037-1044; Krueger et al. (2007) "A human interleukin-12/23 monoclonal antibody for the treatment of psoriasis". *N Engl J Med* 356:580-592; Mannon et al. (2004) "Anti-interleukin-12 antibody for active Crohn's disease". *N Engl J Med* 351: 2069-2079; and Park et al. (2005) "A distinct lineage of CD4 T cells regulates tissue inflammation by producing interleukin 17". *Nat Immun* 6:1133-1141.

IL12 and IL23 Therapeutics/Pharmacogenomics in Inflammatory and Autoimmune Disorders Exemplary embodiments of the invention provide SNPs in the IL12B and IL23R regions that are particularly associated with psoriasis (as shown in the tables and described in the Examples section, for example). These SNPs have a variety of therapeutic and pharmacogenomic uses related to the treatment of psoriasis, as well as other inflammatory and autoimmmune disorders such as inflammatory bowel disease (including Crohn's disease and ulcerative colitis), atopic dermatitis, ankylosing spondylitis, rheumatoid arthritis, multiple sclerosis, celiac disease, Graves' disease, and Barrett's esophagus. The psoriasis-associated SNPs provided herein may be used, for example, to determine variability between different individuals in their response to an inflammatory or autoimmune disease therapy (e.g., a psoriasis therapy or a therapy for inflammatory bowel disease, Crohn's disease, ulcerative colitis, atopic dermatitis, ankylosing spondylitis, rheumatoid arthritis, multiple sclerosis, celiac disease, Graves' disease, Barrett's esophagus, or other inflammatory or autoimmune disorder) such as to predict whether an individual will respond positively to a particular therapy, to determine the most effective therapeutic agent (e.g., antibody, therapeutic protein, small molecule compound, nucleic acid agent, etc.) to use to treat an individual, to determine whether a particular therapeutic agent should or should not be administered to an individual (e.g., by predicting whether the individual is likely to positively respond to the therapy or by predicting whether the individual will experience toxic or other other undesirable side effects or is unlikely to respond to the therapy), or to determine the therapeutic regimen to use for an individual such as the dosage or frequency of dosing of a therapeutic agent for a particular individual. Therapeutic agents that directly modulate (e.g., inhibit or stimulate) IL12 or IL23 may be used to treat psoriasis, Crohn's disease, or other inflammatory/ autoimmune disorders and, furthermore, therapeutic agents that target proteins that interact with IL12 or IL23 or are otherwise in IL12 or IL23 pathways may be used to indirectly modulate IL12 or IL23 to thereby treat psoriasis, Crohn's disease, or other inflammatory/autimmune disorders. Any therapeutic agents such as these may be used in conjunction with the SNPs provided herein.

For example, the IL12 and IL23 psoriasis-associated SNPs provided herein may be used to predict whether an individual will respond positively to anti-IL12 and/or anti-IL23 antibody therapy (e.g., anti-IL-12p40 antibodies such as ABT-874 (Abbott) and CNTO-1275 (Centocor); see Veldman, "Targeting the p40 cytokines interleukin (IL)-12 and IL-23 in Crohn's disease", *Drug Discovery Today: Therapeutic Strategies*, Vol. 3, Issue 3, 2006, pp. 375-380, incorporated herein by reference), especially for Crohn's disease, psoriasis, or other autoinflammatory diseases, and/or to determine the most effective dosages of these therapies. This facilitates decision-making by medical practitioners, such as in deciding whether to administer this therapy to a particular individual or select another therapy that may be better suited to the individual, or to use a particular dosage, dosing schedule, or to modify other aspects of a therapeutic regimen to effectively treat the individual, for example.

In addition to medical treatment, these uses may also be applied, for example, in the context of clinical trials of a therapeutic agent (e.g., a therapeutic agent that targets IL12 or IL23 for the treatment of psoriasis, inflammatory bowel disease, Crohn's disease, ulcerative colitis, atopic dermatitis, ankylosing spondylitis, rheumatoid arthritis, multiple sclerosis, celiac disease, Graves' disease, Barrett's esophagus, or other inflammatory or autimmune disorders), such as to include particular individuals in a clinical trial who are predicted to positively respond to the therapeutic agent based on the SNPs provided herein and/or to exclude particular individuals from a clinical trial who are predicted to not positively respond to the therapeutic agent based on the SNPs provided herein, or to assign individuals to a particular group within a clinical trial. By using the SNPs provided herein to target a therapeutic agent to individuals who are more likely to positively respond to the agent, the therapeutic agent is more likely to succeed in clinical trials by showing positive efficacy and to therefore satisfy the FDA requirements for approval. Additionally, individuals who are more likely to experience toxic or other undesirable side effects may be excluded from being administered the therapeutic agent. Furthermore, by using the SNPs provided herein to determine an effective dosage or dosing frequency, for example, the therapeutic agent may be less likely to exhibit toxicity or other undesirable side effects, as well as more likely to achieve positive efficacy.

Reports, Programmed Computers, Business Methods, and Systems

The results of a test (e.g., an individual's risk for psoriasis, Crohn's disease, or other autoinflammatory disease), or an individual's predicted drug responsiveness (e.g., response to an anti-IL12 or anti-IL23 therapy), based on assaying one or more SNPs disclosed herein, and/or an individual's allele(s)/genotype at one or more SNPs disclosed herein, etc.), and/or any other information pertaining to a test, may be referred to herein as a "report". A tangible report can optionally be generated as part of a testing process (which may be interchangeably referred to herein as "reporting", or as "providing" a report, "producing" a report, or "generating" a report).

Examples of tangible reports may include, but are not limited to, reports in paper (such as computer-generated printouts of test results) or equivalent formats and reports stored on computer readable medium (such as a CD, USB flash drive or other removable storage device, computer hard drive, or computer network server, etc.). Reports, particularly those stored on computer readable medium, can be part of a database, which may optionally be accessible via the internet (such as a database of patient records or genetic information stored on a computer network server, which may be a "secure database" that has security features that limit access to the report, such as to allow only the patient and the patient's medical practioners to view the report while preventing other unauthorized individuals from viewing the report, for example). In addition to, or as an alternative to, generating a tangible report, reports can also be displayed on a computer screen (or the display of another electronic device or instrument).

A report can include, for example, an individual's risk for psoriasis, Crohn's disease, or other autoinflammatory disease, or may just include the allele(s)/genotype that an individual carries at one or more SNPs disclosed herein, which may optionally be linked to information regarding the significance of having the allele(s)/genotype at the SNP (for example, a report on computer readable medium such as a network server may include hyperlink(s) to one or more journal publications or websites that describe the medical/ biological implications, such as increased or decreased disease risk, for individuals having a certain allele/genotype at the SNP). Thus, for example, the report can include disease risk or other medical/biological significance (e.g., drug responsiveness, etc.) as well as optionally also including the allele/genotype information, or the report may just include allele/genotype information without including disease risk or other medical/biological significance (such that an individual viewing the report can use the allele/genotype information to determine the associated disease risk or other medical/biological significance from a source outside of the report itself, such as from a medical practioner, publication, website, etc., which may optionally be linked to the report such as by a hyperlink).

A report can further be "transmitted" or "communicated" (these terms may be used herein interchangeably), such as to the individual who was tested, a medical practitioner (e.g., a doctor, nurse, clinical laboratory practitioner, genetic counselor, etc.), a healthcare organization, a clinical laboratory, and/or any other party or requester intended to view or possess the report. The act of "transmitting" or "communicating" a report can be by any means known in the art, based on the format of the report. Furthermore, "transmitting" or "communicating" a report can include delivering a report ("pushing") and/or retrieving ("pulling") a report. For example, reports can be transmitted/communicated by various means, including being physically transferred between parties (such as for reports in paper format) such as by being physically delivered from one party to another, or by being transmitted electronically or in signal form (e.g., via e-mail or over the internet, by facsimile, and/or by any wired or wireless communication methods known in the art) such as by being retrieved from a database stored on a computer network server, etc.

In certain exemplary embodiments, the invention provides computers (or other apparatus/devices such as biomedical devices or laboratory instrumentation) programmed to carry out the methods described herein. For example, in certain embodiments, the invention provides a computer programmed to receive (i.e., as input) the identity (e.g., the allele(s) or genotype at a SNP) of one or more SNPs disclosed herein and provide (i.e., as output) the disease risk (e.g., an individual's risk for psoriasis, Crohn's disease, or other autoinflammatory disease) or other result (e.g., disease diagnosis or prognosis, drug responsiveness, etc.) based on the identity of the SNP(s). Such output (e.g., communication of disease risk, disease diagnosis or prognosis, drug responsiveness, etc.) may be, for example, in the form of a report on computer readable medium, printed in paper form, and/or displayed on a computer screen or other display.

In various exemplary embodiments, the invention further provides methods of doing business (with respect to methods of doing business, the terms "individual" and "customer" are used herein interchangeably). For example, exemplary methods of doing business can comprise assaying one or more SNPs disclosed herein and providing a report that includes, for example, a customer's risk for psoriasis, Crohn's disease, or other autoinflammatory disease (based on which allele(s)/genotype is present at the assayed SNP(s)) and/or that includes the allele(s)/genotype at the assayed SNP(s) which may optionally be linked to information (e.g., journal publications, websites, etc.) pertaining to disease risk or other biological/medical significance such as by means of a hyperlink (the report may be provided, for example, on a computer network server or other computer readable medium that is internet-accessible, and the report may be included in a secure database that allows the customer to access their report while preventing other unauthorized individuals from viewing the report), and optionally transmitting the report. Customers (or another party who is associated with the customer, such as the customer's doctor, for example) can request/order (e.g., purchase) the test online via the internet (or by phone, mail order, at an outlet/store, etc.), for example, and a kit can be sent/delivered (or otherwise provided) to the customer (or another party on behalf of the customer, such as the customer's doctor, for example) for collection of a biological sample from the customer (e.g., a buccal swab for collecting buccal cells), and the customer (or a party who collects the customer's biological sample) can submit their biological samples for assaying (e.g., to a laboratory or party associated with the laboratory such as a party that accepts the customer samples on behalf of the laboratory, a party for whom the laboratory is under the control of (e.g., the laboratory carries out the assays by request of the party or under a contract with the party, for example), and/or a party that receives at least a portion of the customer's payment for the test). The report (e.g., results of the assay including, for example, the customer's disease risk and/or allele(s)/genotype at the assayed SNP(s)) may be provided to the customer by, for example, the laboratory that assays the SNP(s) or a party associated with the laboratory (e.g., a party that receives at least a portion of the customer's payment for the assay, or a party that requests the laboratory to carry out the assays or that contracts with the laboratory for the assays to be carried out) or a doctor or other medical practitioner who is associated with (e.g., employed by or having a consulting or contracting arrangement with) the laboratory or with a party associated with the laboratory, or the report may be provided to a third party (e.g., a doctor, genetic counselor, hospital, etc.) which optionally provides the report to the customer. In further embodiments, the customer may be a doctor or other medical practitioner, or a hospital, laboratory, medical insurance organization, or other medical organization that requests/orders (e.g., purchases) tests for the purposes of having other individuals (e.g., their patients or customers) assayed for one or more SNPs disclosed herein and optionally obtaining a report of the assay results.

In certain exemplary methods of doing business, a kit for collecting a biological sample (e.g., a buccal swab for collecting buccal cells, or other sample collection device) is provided to a medical practitioner (e.g., a physician) which the medical practitioner uses to obtain a sample (e.g., buccal cells, saliva, blood, etc.) from a patient, the sample is then sent to a laboratory (e.g., a CLIA-certified laboratory) or other facility that tests the sample for one or more SNPs disclosed herein (e.g., to determine the genotype of one or more SNPs disclosed herein, such as to determine the patient's risk for psoriasis, Crohn's disease, or other autoinflammatory disease), and the results of the test (e.g., the patient's genotype at one or more SNPs disclosed herein and/or the patient's disease risk based on their SNP genotype) are provided back to the medical practitioner (and/or directly to the patient and/or to another party such as a hospital, medical insurance company, genetic counselor, etc.) who may then provide or otherwise convey the results to the patient. The results are typically provided in the form of a report, such as described above.

In certain further exemplary methods of doing business, kits for collecting a biological sample from a customer (e.g., a buccal swab for collecting buccal cells, or other sample collection device) are provided (e.g., for sale), such as at an outlet (e.g., a drug store, pharmacy, general merchandise store, or any other desirable outlet), online via the internet, by mail order, etc., whereby customers can obtain (e.g., purchase) the kits, collect their own biological samples, and submit (e.g., send/deliver via mail) their samples to a laboratory (e.g., a CLIA-certified laboratory) or other facility which tests the samples for one or more SNPs disclosed herein (e.g., to determine the genotype of one or more SNPs disclosed herein, such as to determine the customer's risk for psoriasis, Crohn's disease, or other autoinflammatory disease) and provides the results of the test (e.g., of the customer's genotype at one or more SNPs disclosed herein and/or the customer's disease risk based on their SNP genotype) back to the customer and/or to a third party (e.g., a physician or other medical practitioner, hospital, medical insurance company, genetic counselor, etc.). The results are typically provided in the form of a report, such as described above. If the results of the test are provided to a third party, then this third party may optionally provide another report to the customer based on the results of the test (e.g., the result of the test from the laboratory may provide the customer's genotype at one or more SNPs disclosed herein without disease risk information, and the third party may provide a report of the customer's disease risk based on this genotype result).

Certain further embodiments of the invention provide a system for determining an individual's autoinflammatory disease risk (e.g., risk for psoriasis, Crohn's disease, etc.), or whether an individual will benefit from anti-IL12 and/or anti-IL23 treatment (or other therapy) in reducing autoinflammatory disease risk. Certain exemplary systems comprise an integrated "loop" in which an individual (or their medical practitioner) requests a determination of such individual's autoinflammatory disease risk (or drug response, etc.), this determination is carried out by testing a sample from the individual, and then the results of this determination are provided back to the requestor. For example, in certain systems, a sample (e.g., buccal cells, saliva, blood, etc.) is obtained from an individual for testing (the sample may be obtained by the individual or, for example, by a medical practitioner), the sample is submitted to a laboratory (or other facility) for testing (e.g., determining the genotype of one or more SNPs disclosed herein), and then the results of the testing are sent to the patient (which optionally can be done by first sending the results to an intermediary, such as a medical pracioner, who then provides or otherwise conveys the results to the individual and/or acts on the results), thereby forming an integrated loop system for determining an individual's autoinflammatory disease risk (or drug response, etc.). The portions of the system in which the results are transmitted (e.g., between any of a testing facility, a medical practitioner, and/or the individual) can be carried out by way of electronic or signal transmission (e.g., by computer such as via e-mail or the internet, by providing the results on a website or computer network server which may optionally be a secure database, by phone or fax, or by any other wired or wireless transmission methods known in the art). Optionally, the system can further include a risk reduction component (i.e., a disease management system) as part of the integrated loop (for an example of a disease management system, see U.S. Pat. No. 6,770,029, "Disease management system and method including correlation assessment"). For example, the results of the test can be used to reduce the risk of the disease in the individual who was tested, such as by implementing a preventive therapy regimen (e.g., administration of a drug regimen such as an anti-IL12 and/or an anti-IL23 therapy for reducing autoinflammatory disease risk), modifying the individual's diet, increasing exercise, reducing stress, and/or implementing any other physiological or behavioral modifications in the individual with the goal of reducing disease risk. For reducing autoinflammatory disease risk, this may include any means used in the art for improving aspects of an individual's health relevant to reducing autoinflammatory disease risk. Thus, in exemplary embodiments, the system is controlled by the individual and/or their medical pracioner in that the individual and/or their medical pracioner requests the test, receives the test results back, and (optionally) acts on the test results to reduce the individual's disease risk, such as by implementing a disease management system.

The various methods described herein, such as correlating the presence or absence of a polymorphism with an altered (e.g., increased or decreased) risk (or no altered risk) for psoriasis, Crohn's disease, or other autoinflammatory disease (and/or correlating the presence or absence of a polymorphism with the predicted response of an individual to a drug such as an anti-IL12 and/or an anti-IL23 therapy), can be carried out by automated methods such as by using a computer (or other apparatus/devices such as biomedical devices, laboratory instrumentation, or other apparatus/devices having a computer processor) programmed to carry out any of the methods described herein. For example, computer software (which may be interchangeably referred to herein as a computer program) can perform the step of correlating the presence or absence of a polymorphism in an individual with an altered (e.g., increased or decreased) risk (or no altered risk) for autoinflammatory disease (particularly risk for psoriasis or Crohn's disease) for the individual. Computer software can also perform the step of correlating the presence or absence of a polymorphism in an individual with the predicted response of the individual to a drug such as an anti-IL12 and/or an anti-IL23 therapy. Accordingly, certain embodiments of the invention provide a computer (or other apparatus/device) programmed to carry out any of the methods described herein.

Isolated Nucleic Acid Molecules and SNP Detection Reagents & Kits

Tables 1 and 2 provide a variety of information about each SNP of the present invention that is associated with psoriasis, including the transcript sequences (SEQ ID NOS:1-2), genomic sequences (SEQ ID NOS:13-20), and protein sequences (SEQ ID NOS:3-4) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS:5-12 correspond to transcript-based SNP context sequences disclosed in Table 1, and SEQ ID NOS:21-307 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Isolated nucleic acid molecules containing one or more SNPs disclosed in at least one of Tables 1 and 2 may be interchangeably referred to throughout the present text as "SNP-containing nucleic acid molecules." Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated." Nucleic acid molecules present in non-human transgenic animals, which do not naturally occur in the animal, are also considered "isolated." For example, recombinant DNA molecules contained in a vector are considered "isolated." Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably, the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are referred to in Table 1 and provided in the Sequence Listing (SEQ ID NOS:1-2), and polymorphic genomic sequences are referred to in Table 2 and provided in the Sequence Listing (SEQ ID NOS:13-20). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences as disclosed in Tables 1 and 2 (transcript sequences are referred to in Table 1 as SEQ ID NOS:1-2, genomic sequences are referred to in Table 2 as SEQ ID NOS:13-20, transcript-based SNP context sequences are referred to in Table 1 as SEQ ID NOS:5-12, and genomic-based SNP context sequences are referred to in Table 2 as SEQ ID NOS:21-307) and their complements. The actual sequences referred to in the tables are provided in the Sequence Listing. A fragment typically comprises a contiguous nucleotide sequence at least about 8 or more nucleotides, more preferably at least about 12 or more nucleotides, and even more preferably at least about 16 or more nucleotides. Furthermore, a fragment could comprise at least about 18, 20, 22, 25, 30, 40, 50, 60, 80, 100, 150, 200, 250 or 500 nucleotides in length (or any other number in between). The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195 and 4,683,202; *PCR Technology: Principles and Applications for DNA Amplification*, ed. H. A. Erlich, Freeman Press, NY, NY (1992)), ligase chain reaction (LCR) (Wu and Wallace, *Genomics* 4:560 (1989); Landegren et al., *Science* 241:1077 (1988)), strand displacement amplification (SDA) (U.S. Pat. Nos. 5,270,184 and 5,422,252), transcription-mediated amplification (TMA) (U.S. Pat. No. 5,399,491), linked linear amplification (LLA) (U.S. Pat. No. 6,027,923) and the like, and isothermal amplification methods such as nucleic acid sequence based amplification (NASBA) and self-sustained sequence replication (Guatelli et al., *Proc Natl Acad Sci USA* 87:1874 (1990)). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1 and 2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product. However, as indicated above, the SNP of interest may be located anywhere along the length of the amplified product.

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are referred to in Table 1 as SEQ ID NOS:1-2, genomic sequences are referred to in Table 2 as SEQ ID NOS:13-20, transcript-based SNP context sequences are referred to in Table 1 as SEQ ID NOS:5-12, and genomic-based SNP context sequences are referred to in Table 2 as SEQ ID NOS:21-307), or any nucleic acid molecule that encodes any of the variant proteins referred to in Table 1 (SEQ ID NOS:3-4). The actual sequences referred to in the tables are provided in the Sequence Listing. A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences referred to in Table 1 and/or Table 2 (transcript sequences are referred to in Table 1 as SEQ ID NOS:1-2, genomic sequences are referred to in Table 2 as SEQ ID NOS:13-20, transcript-based SNP context sequences are referred to in Table 1 as SEQ ID NOS:5-12, and genomic-based SNP context sequences are referred to in Table 2 as SEQ ID NOS:21-307), or any nucleic acid molecule that encodes any of the variant proteins referred to in Table 1 (SEQ ID NOS:3-4). The actual sequences referred to in the tables are provided in the Sequence Listing. A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are referred to in Table 1 as SEQ ID NOS:1-2, genomic sequences are referred to in Table 2 as SEQ ID NOS:13-20, transcript-based SNP context sequences are referred to in Table 1 as SEQ ID NOS: 5-12, and genomic-based SNP context sequences are referred to in Table 2 as SEQ ID NOS:21-307), or any nucleic acid molecule that encodes any of the variant proteins provided in Table 1 (SEQ ID NOS:3-4). The actual sequences referred to in the tables are provided in the Sequence Listing. A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art. Sambrook and Russell, *Molecular Cloning: A Laboratory Manual*, Cold Spring Harbor Press, N.Y. (2000).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof. Sambrook and Russell, *Molecular Cloning: A Laboratory Manual*, Cold Spring Harbor Press, N.Y. (2000). Furthermore, isolated nucleic acid molecules, particularly SNP detection reagents such as probes and primers, can also be partially or completely in the form of one or more types of nucleic acid analogs, such as peptide nucleic acid (PNA). U.S. Pat. Nos. 5,539,082; 5,527,675; 5,623,049; and 5,714,331. The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art. See, e.g., Corey, "Peptide nucleic acids: expanding the scope of nucleic acid recognition," *Trends Biotechnol* 15(6):224-9

(June 1997), and Hyrup et al., "Peptide nucleic acids (PNA): synthesis, properties and potential applications," *Bioorg Med Chem* 4(1):5-23) (January 1996). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone. Lagriffoul et al., *Bioorganic & Medicinal Chemistry Letters* 4:1081-1082 (1994); Petersen et al., *Bioorganic & Medicinal Chemistry Letters* 6:793-796 (1996); Kumar et al., *Organic Letters* 3(9):1269-1272 (2001); WO 96/04000. PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1 and 2). Variation can occur in either or both the coding and non-coding regions. The variations can produce conservative and/or non-conservative amino acid substitutions.

Further variants of the nucleic acid molecules disclosed in Tables 1 and 2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences referred to and shown in Tables 1 and 2, and can encode a polypeptide that varies to some degree from the specific polypeptide sequences referred to in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. *Computational Molecular Biology*, A. M. Lesk, ed., Oxford University Press, N.Y (1988); *Biocomputing: Informatics and Genome Projects*, D. W. Smith, ed., Academic Press, N.Y. (1993); *Computer Analysis of Sequence Data*, Part 1, A.M. Griffin and H. G. Griffin, eds., Humana Press, N.J. (1994); *Sequence Analysis in Molecular Biology*, G. von Heinje, ed., Academic Press, N.Y. (1987); and *Sequence Analysis Primer*, M. Gribskov and J. Devereux, eds., M. Stockton Press, N.Y. (1991). In a preferred embodiment, the percent identity between two amino acid sequences is determined using the Needleman and Wunsch algorithm (*J Mol Biol* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package using a NWSgapdna.CMP matrix and a gap weight of 40, 50, 60, 70, or 80 and a length weight of 1, 2, 3, 4, 5, or 6. J. Devereux et al., *Nucleic Acids Res.* 12(1):387 (1984). In another embodiment, the percent identity between two amino acid or nucleotide sequences is determined using the algorithm of E. Myers and W. Miller (CABIOS 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases; for example, to identify other family members or related sequences. Such searches can be performed using the NBLAST and XBLAST programs (version 2.0). Altschul et al., *J Mol Biol* 215:403-10 (1990). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized. Altschul et al., *Nucleic Acids Res* 25(17):3389-3402 (1997). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol Biol* 25, 365-389 (1994)) and KERR (Dufresne et al., *Nat Biotechnol* 20(12):1269-71 (December 2002)). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (referred to in Table 1 as SEQ ID NOS:1-2), genomic sequences (referred to in Table 2 as SEQ ID NOS:13-20), and context sequences (transcript-based context sequences are referred to in Table 1 as SEQ ID NOS:5-12; genomic-based context sequences are provided in Table 2 as SEQ ID NOS:21-307), can be used for the design of SNP detection reagents. The actual sequences referred to in the tables are provided in the Sequence Listing. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs referred to in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences referred to in Table 1 and/or Table 2 (transcript-based context sequences are referred to in Table 1 as SEQ ID NOS:5-12; genomic-based context sequences are referred to in Table 2 as SEQ ID NOS:21-307). Another example of a detection reagent is a primer that acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g. probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS:1-2), genomic sequences (SEQ ID NOS:13-20), and SNP context sequences (transcript-based context sequences are referred to in Table 1 as SEQ ID NOS:5-12; genomic-based context sequences are referred to in Table 2 as SEQ ID NOS:21-307) disclosed in the Sequence Listing and in Tables 1 and 2. The actual sequences referred to in the tables are provided in the Sequence Listing. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm that starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides that detect single nucleotide variations in target sequences may be referred to by such terms as "allele-specific oligonucleotides," "allele-specific probes," or "allele-specific primers." The design and use of allele-specific probes for analyzing polymorphisms is described in, e.g., Mutation Detection: A Practical Approach, Cotton et al., eds., Oxford University Press (1998); Saiki et al., *Nature* 324:163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: prehybridization with a solution containing 5× standard saline phosphate EDTA (SSPE), 0.5% NaDodSO$_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment that is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art. Chemical synthetic methods include, but are not limited to, the phosphotriester method described by Narang et al., *Methods in Enzymology* 68:90 (1979); the phosphodiester method described by Brown et al., *Methods in Enzymology* 68:109 (1979); the diethylphosphoamidate method described by Beaucage et al., *Tetrahedron Letters* 22:1859 (1981); and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity. Gibbs, *Nucleic Acid Res* 17:2427-2448 (1989). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210, 015 and 5,538,848) or Molecular Beacon probe (U.S. Pat. Nos. 5,118,801 and 5,312,728), or other stemless or linear beacon probe (Livak et al., *PCR Method Appl* 4:357-362 (1995); Tyagi et al., *Nature Biotechnology* 14:303-308 (1996); Nazarenko et al., *Nucl Acids Res* 25:2516-2521 (1997); U.S. Pat. Nos. 5,866,336 and 6,117,635.

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems," as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g. TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g. a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays," "microarrays," and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in Chee et al., U.S. Pat. No. 5,837,832 and PCT application WO95/11995; D. J. Lockhart et al., *Nat Biotech* 14:1675-1680 (1996); and M. Schena et al., *Proc Natl Acad Sci* 93:10614-10619 (1996), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics," *Biotechnol Annu Rev* 8:85-101 (2002); Sosnowski et al., "Active microelectronic array system for DNA hybridization, genotyping and pharmacogenomic applications," *Psychiatr Genet* 12(4):181-92 (December 2002); Heller, "DNA microarray technology: devices, systems, and applications," *Annu Rev Biomed Eng* 4:129-53 (2002); Epub Mar. 22, 2002; Kolchinsky et al., "Analysis of SNPs and other genomic variations using gel-based chips," *Hum Mutat* 19(4):343-60 (April 2002); and McGall et al., "High-density genechip oligonucleotide probe arrays," *Adv Biochem Eng Biotechnol* 77:21-42 (2002).

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology* 6.3.1-6.3.6, John Wiley & Sons, N.Y. (1989).

In other embodiments, the arrays are used in conjunction with chemiluminescent detection technology. The following patents and patent applications, which are all hereby incorporated by reference, provide additional information pertaining to chemiluminescent detection. U.S. patent applications that describe chemiluminescent approaches for microarray detection: Ser. Nos. 10/620,332 and 10/620,333. U.S. patents that describe methods and compositions of dioxetane for performing chemiluminescent detection: U.S. Pat. Nos. 6,124,478; 6,107,024; 5,994,073; 5,981,768; 5,871,938; 5,843,681; 5,800,999 and 5,773,628. And the U.S. published application that discloses methods and compositions for microarray controls: US2002/0110828.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells), biopsies, buccal swabs or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM™ 6700 sample preparation system, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art. See, e.g., Weigl et al., "Lab-on-a-chip for drug development," Adv Drug Deliv Rev 55(3): 349-77 (February 2003). In such microfluidic devices, the containers may be referred to as, for example, microfluidic "compartments," "chambers," or "channels."

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micromachined channels and to change the liquid flow rate for pumping across different sections of the microchip. See, for example, U.S. Pat. Nos. 6,153,073, Dubrow et al., and 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, especially for the diagnosis, prognosis, treatment, and prevention of psoriasis, and for predicting drug response. For example, the nucleic acid molecules of the invention are useful for predicting an individual's risk for developing psoriasis, for prognosing the progression of psoriasis (e.g., the severity or consequences of psoriasis) in an individual, in evaluating the likelihood of an individual who has psoriasis (or who is at increased risk for psoriasis) of responding to treatment (or prevention) of psoriasis with a drug treatment, and/or predicting the likelihood that the individual will experience toxicity or other undesirable side effects from the drug treatment, etc. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule referred to in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations. Sambrook and Russell, *Molecular Cloning: A Laboratory Manual*, Cold Spring Harbor Press, N.Y. (2000).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphism(s) is at risk for developing psoriasis (or has already developed early stage psoriasis), or the likelihood that an individual will respond positively to a drug treatment (including preventive treatment) of psoriasis. Detection of a SNP associated with a disease phenotype provides a diagnostic tool for an active disease and/or genetic predisposition to the disease.

Furthermore, the nucleic acid molecules of the invention are therefore useful for detecting a gene (gene information is disclosed in Table 2, for example) which contains a SNP disclosed herein and/or products of such genes, such as expressed mRNA transcript molecules (transcript information is disclosed in Table 1, for example), and are thus useful for detecting gene expression. The nucleic acid molecules can optionally be implemented in, for example, an array or kit format for use in detecting gene expression.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences referred to in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allows, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which nucleotide(s) is/are present at each of one or more SNP positions (such as a SNP position disclosed in Table 1 and/or Table 2), for either or both alleles, may be referred to by such phrases as SNP genotyping, determining the "identity" of a SNP, determining the "content" of a SNP, or determining which nucleotide(s)/allele(s) is/are present at a SNP position. Thus, these terms can refer to detecting a single allele (nucleotide) at a SNP position or can encompass detecting both alleles (nucleotides) at a SNP position (such as to determine the homozygous or heterozygous state of a SNP position). Furthermore, these terms may also refer to detecting an amino acid residue encoded by a SNP (such as alternative amino acid residues that are encoded by different codons created by alternative nucleotides at a SNP position).

The present invention provides methods of SNP genotyping, such as for use in evaluating an individual's risk for developing psoriasis, for evaluating an individual's prognosis for disease severity and recovery, for predicting the likelihood that an individual who has previously had psoriasis will have a recurrence of psoriasis again in the future, for implementing a preventive or treatment regimen for an individual based on that individual having an increased susceptibility for developing psoriasis, in evaluating an individual's likelihood of responding to a drug treatment (particularly for treating or preventing psoriasis), in selecting a treatment or preventive regimen (e.g., in deciding whether or not to administer a drug treatment to an individual having psoriasis, or who is at increased risk for developing psoriasis in the future), or in formulating or selecting a particular treatment or preventive regimen such as dosage and/or frequency of administration of a treatment or choosing which form/type of a drug to be administered, such as a particular pharmaceutical composition or compound, etc.), determining the likelihood of experiencing toxicity or other undesirable side effects from a drug treatment, or selecting individuals for a clinical trial of a drug (e.g., selecting individuals to participate in the trial who are most likely to respond positively from the drug treatment and/or excluding individuals from the trial who are unlikely to respond positively from the drug treatment based on their SNP genotype(s), or selecting individuals who are unlikely to respond positively to a particular drug based on their SNP genotype(s) to participate in a clinical trial of another type of drug that may benefit them), etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput," *Pharmacogenomics J* 3(2): 77-96 (2003); Kwok et al., "Detection of single nucleotide polymorphisms," *Curr Issues Mol Biol* 5(2):43-60 (April 2003); Shi, "Technologies for individual genotyping: detection of genetic polymorphisms in drug targets and disease genes," *Am J Pharmacogenomics* 2(3):197-205 (2002); and Kwok, "Methods for genotyping single nucleotide polymorphisms," *Annu Rev Genomics Hum Genet* 2:235-58 (2001). Exemplary techniques for high-throughput SNP genotyping are described in Marnellos, "High-throughput SNP analysis for genetic association studies," *Curr Opin Drug Discov Devel* 6(3):317-21 (May 2003). Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al., *PNAS* 85:4397 (1988); and Saleeba et al., *Meth. Enzymol* 217:286-295 (1992)), comparison of the electrophoretic mobility of variant and wild type nucleic acid molecules (Orita et al., *PNAS* 86:2766 (1989); Cotton et al., *Mutat Res* 285:125-144 (1993); and Hayashi et al., *Genet Anal Tech Appl* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and S1 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in, for example, screening for individuals who are susceptible to developing psoriasis and related pathologies, or in screening individuals who have psoriasis (or who are susceptible to psoriasis) for their likelihood of responding to a drug treatment. These probes and primers can be readily incorporated into a kit format. The present invention also includes modifications of the Taqman assay well known in the art such as the use of Molecular Beacon probes (U.S. Pat. Nos. 5,118,801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA. The following U.S. patents describe OLA strategies for performing SNP detection: U.S. Pat. Nos. 6,027,889; 6,268,148; 5,494,810; 5,830,711 and 6,054,564. WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array. U.S. application US01/17329 (and 09/584,905) describes OLA (or LDR) followed by PCR, wherein zipcodes are incorporated into OLA probes, and amplified PCR products are determined by electrophoretic or universal zipcode array readout. U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry," *Rapid Commun Mass Spectrom* 17(11):1195-202 (2003).

The following references provide further information describing mass spectrometry-based methods for SNP genotyping: Bocker, "SNP and mutation discovery using base-specific cleavage and MALDI-TOF mass spectrometry," *Bioinformatics* 19 Suppl 1:144-153 (July 2003); Storm et al., "MALDI-TOF mass spectrometry-based SNP genotyping," *Methods Mol Biol* 212:241-62 (2003); Jurinke et al., "The use of Mass ARRAY technology for high throughput genotyping," *Adv Biochem Eng Biotechnol* 77:57-74 (2002); and Jurinke et al., "Automated genotyping using the DNA MassArray technology," *Methods Mol Biol* 187:179-92 (2002).

SNPs can also be scored by direct DNA sequencing. A variety of automated sequencing procedures can be utilized (e.g. *Biotechniques* 19:448 (1995)), including sequencing by mass spectrometry. See, e.g., PCT International Publication No. WO 94/16101; Cohen et al., *Adv Chromatogr* 36:127-162 (1996); and Griffin et al., *Appl Biochem Biotechnol* 38:147-159 (1993). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730xl DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE). Myers et al., *Nature* 313:495 (1985). SSCP identifies base differences by alteration in electrophoretic migration of single stranded PCR products, as described in Orita et al., *Proc. Nat. Acad*. Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel. *PCR Technology: Principles and Applications for DNA Amplification Chapter 7*, Erlich, ed., W.H. Freeman and Co, N.Y. (1992).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis.

SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying patient populations for clinical trials of a therapeutic, preventive, or diagnostic agent, predicting the likelihood that an individual will experience toxic side effects from a therapeutic agent, and human identification applications such as forensics.

Analysis of Genetic Associations Between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies. *Modern Epidemiology* 609-622, Lippincott, Williams & Wilkins (1998). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease. B. Weir, *Genetic Data Analysis*, Sinauer (1990).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive or allelic (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions). Hosmer and Lemeshow, *Applied Logistic Regression*, Wiley (2000). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $r^2$, are typically calculated for the markers within a gene to elucidate the haplotype structure. Recent studies in linkage disequilibrium indicate that SNPs within a gene are organized in block pattern, and a high degree of linkage disequilibrium exists within blocks and very little linkage disequilibrium exists between blocks. Daly et al, *Nature Genetics* 29:232-235 (2001). Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed that score tests can be done on haplotypes using the program "haplo.score." Schaid et al, *Am J Hum Genet* 70:425-434 (2002). In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the P value of the tests reaches that level. In an exploratory analysis where positive hits will be followed up in subsequent confirmatory testing, an unadjusted P value <0.2 (a significance level on the lenient side), for example, may be used for generating hypotheses for significant association of a SNP with certain phenotypic characteristics of a disease. It is preferred that a p-value <0.05 (a significance level traditionally used in the art) is achieved in order for a SNP to be considered to have an association with a disease. It is more preferred that a p-value <0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wide error rates at 0.05. While there are different methods to adjust for multiple testing to control for different kinds of error rates, a commonly used but rather conservative method is Bonferroni correction to control the experiment-wise or family-wise error rate. Westfall et al., *Multiple comparisons and multiple tests*, SAS Institute (1999). Permutation tests to control for the false discovery rates, FDR, can be more powerful. Benjamini and Hochberg, *Journal of the Royal Statistical Society*, Series B 57:1289-1300 (1995); Westfall and Young, *Resampling-based Multiple Testing*, Wiley (1993). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies. *Modern Epidemiology* 643-673, Lippincott, Williams & Wilkins (1998). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies when prevalence of the disease is associated with different subpopulation groups. Ewens and Spielman, *Am J Hum Genet* 62:450-458 (1995). Such bias can also lead to a loss of statistical power in genetic association studies. To detect population stratification, Pritchard and Rosenberg suggested typing markers that are unlinked to the disease and using results of association tests on those markers to determine whether there is any population stratification. Pritchard et al., *Am J Hum Gen* 65:220-228 (1999). When stratification is detected, the genomic control (GC) method as proposed by Devlin and Roeder can be used to adjust for the inflation of test statistics due to population stratification. Devlin et al., *Biometrics* 55:997-1004 (1999). The GC method is robust to changes in population structure levels as well as being applicable to DNA pooling designs. Devlin et al., *Genet Epidem* 21:273-284 (2001).

While Pritchard's method recommended using 15-20 unlinked microsatellite markers, it suggested using more than 30 biallelic markers to get enough power to detect population stratification. For the GC method, it has been shown that about 60-70 biallelic markers are sufficient to estimate the inflation factor for the test statistics due to population stratification. Bacanu et al., *Am J Hum Genet* 66:1933-1944 (2000). Hence, 70 intergenic SNPs can be chosen in unlinked regions as indicated in a genome scan. Kehoe et al., *Hum Mol Genet* 8:237-245 (1999).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks. Draper and Smith, *Applied Regression Analysis*, Wiley (1998). Moreover, other techniques can also be used for setting up classification. Such techniques include, but are not limited to, MART, CART, neural network, and discriminant analyses that are suitable for use in comparing the performance of different methods. *The Elements of Statistical Learning*, Hastie, Tibshirani & Friedman, Springer (2002).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the risk allele(s).

The SNPs of the invention may contribute to the development of psoriasis, or to responsiveness of an individual to a drug treatment, in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose," "diagnosis," and "diagnostics" include, but are not limited to, any of the following: detection of psoriasis that an individual may presently have, predisposition/susceptibility/predictive screening (i.e., determining whether an individual has an increased or decreased risk of developing psoriasis in the future), prognosing the future course of psoriasis or recurrence of psoriasis in an individual, determining a particular type or subclass of psoriasis in an individual who currently or previously had psoriasis, confirming or reinforcing a previously made diagnosis of psoriasis, evaluating an individual's likelihood of responding positively to a particular treatment or therapeutic agent (particularly treatment or prevention of psoriasis), determining or selecting a therapeutic or preventive strategy that an individual is most likely to positively respond to (e.g., selecting a particular therapeutic agent, or combination of therapeutic agents, or determining a dosing regimen, etc.), classifying (or confirming/reinforcing) an individual as a responder/non-responder (or determining a particular subtype of responder/non-responder) with respect to the individual's response to a drug treatment, and predicting whether a patient is likely to experience toxic effects from a particular treatment or therapeutic compound. Such diagnostic uses can be based on the SNPs individually or in a unique combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium." In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby.

Hence, genotyping one of the SNP sites will give almost the same information as genotyping the other SNP site that is in LD.

Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic purposes and similar uses, if a particular SNP site is found to be useful for, for example, predicting an individual's susceptibility to psoriasis or an individual's response to a drug treatment, then the skilled artisan would recognize that other SNP sites which are in LD with this SNP site would also be useful for the same purposes. Thus, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., psoriasis, or responder/non-responder to a drug treatment) that is influenced by the causative SNP(s). Therefore, polymorphic markers that are in LD with causative polymorphisms are useful as diagnostic markers, and are particularly useful when the actual causative polymorphism(s) is/are unknown.

Examples of polymorphisms that can be in LD with one or more causative polymorphisms (and/or in LD with one or more polymorphisms that have a significant statistical association with a condition) and therefore useful for diagnosing the same condition that the causative/associated SNP(s) is used to diagnose, include other SNPs in the same gene, protein-coding, or mRNA transcript-coding region as the causative/associated SNP, other SNPs in the same exon or same intron as the causative/associated SNP, other SNPs in the same haplotype block as the causative/associated SNP, other SNPs in the same intergenic region as the causative/associated SNP, SNPs that are outside but near a gene (e.g., within 6 kb on either side, 5' or 3', of a gene boundary) that harbors a causative/associated SNP, etc. Such useful LD SNPs can be selected from among the SNPs disclosed in Tables 1 and 2, for example.

Linkage disequilibrium in the human genome is reviewed in Wall et al., "Haplotype blocks and linkage disequilibrium in the human genome," *Nat Rev Genet* 4(8):587-97 (August 2003); Garner et al., "On selecting markers for association studies: patterns of linkage disequilibrium between two and three diallelic loci," *Genet Epidemiol* 24(1):57-67 (January 2003); Ardlie et al., "Patterns of linkage disequilibrium in the human genome," *Nat Rev Genet* 3(4):299-309 (April 2002); erratum in *Nat Rev Genet* 3(7):566 (July 2002); and Remm et al., "High-density genotyping and linkage disequilibrium in the human genome using chromosome 22 as a model," *Curr Opin Chem Biol* 6(1):24-30 (February 2002); J. B. S. Haldane, "The combination of linkage values, and the calculation of distances between the loci of linked factors," *J Genet* 8:299-309 (1919); G. Mendel, *Versuche über Pflanzen-Hybriden. Verhandlungen des naturforschenden Vereines in Brünn* (*Proceedings of the Natural History Society of Brünn*) (1866); Genes IV, B. Lewin, ed., Oxford University Press, N.Y. (1990); D. L. Hartl and A.G. Clark Principles of Population Genetics $2^{nd}$ ed., Sinauer Associates, Inc., Mass. (1989); J. H. Gillespie *Population Genetics: A Concise Guide.* $2^{nd}$ ed., Johns Hopkins University Press (2004); R. C. Lewontin, "The interaction of selection and linkage. I. General considerations; heterotic models," *Genetics* 49:49-67 (1964); P. G. Hoel, *Introduction to Mathematical Statistics* $2^{nd}$ ed., John Wiley & Sons, Inc., N.Y. (1954); R. R. Hudson, "Two-locus sampling distributions and their application," *Genetics* 159:1805-1817 (2001); A. P. Dempster, N.M. Laird, D. B. Rubin, "Maximum likelihood from incomplete data via the EM algorithm," *J R Stat Soc* 39:1-38 (1977); L. Excoffier, M. Slatkin, "Maximum-likelihood estimation of molecular haplotype frequencies in a diploid population," *Mol Biol Evol* 12(5):921-927 (1995); D. A. Tregouet, S. Escolano, L. Tiret, A. Mallet, J. L. Golmard, "A new algorithm for haplotype-based association analysis: the Stochastic-EM algorithm," *Ann Hum Genet* 68(Pt 2):165-177 (2004); A. D. Long and C. H. Langley C H, "The power of association studies to detect the contribution of candidate genetic loci to variation in complex traits," *Genome Research* 9:720-731 (1999); A. Agresti, *Categorical Data Analysis*, John Wiley & Sons, Inc., N.Y. (1990); K. Lange, *Mathematical and Statistical Methods for Genetic Analysis*, Springer-Verlag New York, Inc., N.Y. (1997); The International HapMap Consortium, "The International HapMap Project," *Nature* 426:789-796 (2003); The International HapMap Consortium, "A haplotype map of the human genome," *Nature* 437:1299-1320 (2005); G. A. Thorisson, A. V. Smith, L. Krishnan, L. D. Stein, "The International HapMap Project Web Site," *Genome Research* 15:1591-1593 (2005); G. McVean, C. C. A. Spencer, R. Chaix, "Perspectives on human genetic variation from the HapMap project," *PLoS Genetics* 1(4):413-418 (2005); J. N. Hirschhorn, M. J. Daly, "Genome-wide association studies for common diseases and complex traits," *Nat Genet* 6:95-108 (2005); S. J. Schrodi, "A probabilistic approach to large-scale association scans: a semi-Bayesian method to detect disease-predisposing alleles," *SAGMB* 4(1):31 (2005); W. Y. S. Wang, B. J. Barratt, D. G. Clayton, J.A. Todd, "Genome-wide association studies: theoretical and practical concerns," *Nat Rev Genet* 6:109-118 (2005); J. K. Pritchard, M. Przeworski, "Linkage disequilibrium in humans: models and data," *Am J Hum Genet* 69:1-14 (2001).

As discussed above, one aspect of the present invention is the discovery that SNPs that are in certain LD distance with an interrogated SNP can also be used as valid markers for determining whether an individual has an increased or decreased risk of having or developing psoriasis. As used herein, the term "interrogated SNP" refers to SNPs that have been found to be associated with an increased or decreased risk of disease using genotyping results and analysis, or other appropriate experimental method as exemplified in the working examples described in this application. As used herein, the term "LD SNP" refers to a SNP that has been characterized as a SNP associating with an increased or decreased risk of diseases due to their being in LD with the "interrogated SNP" under the methods of calculation described in the application. Below, applicants describe the methods of calculation with which one of ordinary skilled in the art may determine if a particular SNP is in LD with an interrogated SNP. The parameter $r^2$ is commonly used in the genetics art to characterize the extent of linkage disequilibrium between markers (Hudson, 2001). As used herein, the term "in LD with" refers to a particular SNP that is measured at above the threshold of a parameter such as $r^2$ with an interrogated SNP.

It is now common place to directly observe genetic variants in a sample of chromosomes obtained from a population. Suppose one has genotype data at two genetic markers located on the same chromosome, for the markers A and B. Further suppose that two alleles segregate at each of these two markers such that alleles $A_1$ and $A_2$ can be found at marker A and alleles $B_1$ and $B_2$ at marker B. Also assume that these two markers are on a human autosome. If one is to examine a specific individual and find that they are heterozygous at both markers, such that their two-marker genotype is $A_1A_2B_1B_2$, then there are two possible configurations: the individual in question could have the alleles $A_1B_1$ on one chromosome and $A_2B_2$ on the remaining chromosome; alternatively, the individual could have alleles $A_1B_2$ on one chromosome and $A_2B_1$ on the other. The arrangement of alleles on a chromosome is called a haplotype. In this illustration, the individual could have haplotypes $A_1B_1/A_2B_2$ or $A_1B_2/A_2B_1$ (see Hartl and Clark (1989) for a more complete description). The concept of linkage equilibrium relates the frequency of haplotypes to the allele frequencies.

Assume that a sample of individuals is selected from a larger population. Considering the two markers described above, each having two alleles, there are four possible haplotypes: $A_1B_1$, $A_1/B_2$, $A_2/B_1$ and $A_2B_2$. Denote the frequencies of these four haplotypes with the following notation.

$$P_{11}=\text{freq}(A_1B_1) \tag{1}$$

$$P_{12}=\text{freq}(A_1B_2) \tag{2}$$

$$P_{21}=\text{freq}(A_2B_1) \tag{3}$$

$$P_{22}=\text{freq}(A_2B_2) \tag{4}$$

The allele frequencies at the two markers are then the sum of different haplotype frequencies, it is straightforward to write down a similar set of equations relating single-marker allele frequencies to two-marker haplotype frequencies:

$$p_1=\text{freq}(A_1)=P_{11}+P_{12} \tag{5}$$

$$p_2=\text{freq}(A_2)=P_{21}+P_{22} \tag{6}$$

$$q_1=\text{freq}(B_1)=P_{11}+P_{21} \tag{7}$$

$$q_2=\text{freq}(B_2)=P_{12}+P_{22} \tag{8}$$

Note that the four haplotype frequencies and the allele frequencies at each marker must sum to a frequency of 1.

$$P_{11}+P_{12}+P_{21}+P_{22}=1 \tag{9}$$

$$p_1+p_2=1 \tag{10}$$

$$q_1+q_2=1 \tag{11}$$

If there is no correlation between the alleles at the two markers, one would expect that the frequency of the haplotypes would be approximately the product of the composite alleles. Therefore, $$P_{11}\approx p_1q_1 \tag{12}$$

$$P_{12}\approx p_1q_2 \tag{13}$$

$$P_{21}\approx p_2q_1 \tag{14}$$

$$P_{22}\approx p_2q_2 \tag{15}$$

These approximating equations (12)-(15) represent the concept of linkage equilibrium where there is independent assortment between the two markers—the alleles at the two markers occur together at random. These are represented as approximations because linkage equilibrium and linkage disequilibrium are concepts typically thought of as properties of a sample of chromosomes; and as such they are susceptible to stochastic fluctuations due to the sampling process. Empirically, many pairs of genetic markers will be in linkage equilibrium, but certainly not all pairs.

Having established the concept of linkage equilibrium above, applicants can now describe the concept of linkage disequilibrium (LD), which is the deviation from linkage equilibrium. Since the frequency of the $A_1B_1$ haplotype is approximately the product of the allele frequencies for $A_1$ and $B_1$ under the assumption of linkage equilibrium as stated mathematically in (12), a simple measure for the amount of departure from linkage equilibrium is the difference in these two quantities, D, $$D=P_{11}-p_1q_1 \tag{16}$$

D=0 indicates perfect linkage equilibrium. Substantial departures from D=0 indicates LD in the sample of chromosomes examined. Many properties of D are discussed in Lewontin (1964) including the maximum and minimum values that D can take. Mathematically, using basic algebra, it can be shown that D can also be written solely in terms of haplotypes:

$$D=P_{11}P_{22}-P_{12}P_{21} \tag{17}$$

If one transforms D by squaring it and subsequently dividing by the product of the allele frequencies of $A_1$, $A_2$, $B_1$ and $B_2$, the resulting quantity, called $r^2$, is equivalent to the square of the Pearson's correlation coefficient commonly used in statistics (e.g. Hoel, 1954).

$$r^2=\frac{D^2}{p_1p_2q_1q_2} \tag{18}$$

As with D, values of $r^2$ close to 0 indicate linkage equilibrium between the two markers examined in the sample set. As values of $r^2$ increase, the two markers are said to be in linkage disequilibrium. The range of values that $r^2$ can take are from 0 to 1. $r^2=1$ when there is a perfect correlation between the alleles at the two markers.

In addition, the quantities discussed above are sample-specific. And as such, it is necessary to formulate notation specific to the samples studied. In the approach discussed here, three types of samples are of primary interest: (i) a sample of chromosomes from individuals affected by a disease-related phenotype (cases), (ii) a sample of chromosomes obtained from individuals not affected by the disease-related phenotype (controls), and (iii) a standard sample set used for the construction of haplotypes and calculation pairwise linkage disequilibrium. For the allele frequencies used in the development of the method described below, an additional subscript will be added to denote either the case or control sample sets.

$$p_{1,cs}=\text{freq}(A_1 \text{ in cases}) \tag{19}$$

$$p_{2,cs}=\text{freq}(A_2 \text{ in cases}) \tag{20}$$

$$q_{1,cs}=\text{freq}(B_1 \text{ in cases}) \tag{21}$$

$$q_{2,cs}=\text{freq}(B_2 \text{ in cases}) \tag{22}$$

Similarly, $$p_{1,ct}=\text{freq}(A_1 \text{ in controls}) \tag{23}$$

$$p_{2,ct}=\text{freq}(A_2 \text{ in controls}) \tag{24}$$

$$q_{1,ct} = \text{freq}(B_1 \text{ in controls}) \qquad (25)$$

$$q_{2,ct} = \text{freq}(B_2 \text{ in controls}) \qquad (26)$$

As a well-accepted sample set is necessary for robust linkage disequilibrium calculations, data obtained from the International HapMap project (The International HapMap Consortium 2003, 2005; Thorisson et al, 2005; McVean et al, 2005) can be used for the calculation of pairwise $r^2$ values. Indeed, the samples genotyped for the International HapMap Project were selected to be representative examples from various human sub-populations with sufficient numbers of chromosomes examined to draw meaningful and robust conclusions from the patterns of genetic variation observed. The International HapMap project website (hapmap.org) contains a description of the project, methods utilized and samples examined. It is useful to examine empirical data to get a sense of the patterns present in such data.

Haplotype frequencies were explicit arguments in equation (18) above. However, knowing the 2-marker haplotype frequencies requires that phase to be determined for doubly heterozygous samples. When phase is unknown in the data examined, various algorithms can be used to infer phase from the genotype data. This issue was discussed earlier where the doubly heterozygous individual with a 2-SNP genotype of $A_1A_2B_1B_2$ could have one of two different sets of chromosomes: $A_1B_1/A_2B_2$ or $A_1B_2/A_2B_1$. One such algorithm to estimate haplotype frequencies is the expectation-maximization (EM) algorithm first formalized by Dempster et al. (1977). This algorithm is often used in genetics to infer haplotype frequencies from genotype data (e.g. Excoffier and Slatkin (1995); Tregouet et al. (2004)). It should be noted that for the two-SNP case explored here, EM algorithms have very little error provided that the allele frequencies and sample sizes are not too small. The impact on $r^2$ values is typically negligible.

As correlated genetic markers share information, interrogation of SNP markers in LD with a disease-associated SNP marker can also have sufficient power to detect disease association (Long and Langley (1999)). The relationship between the power to directly find disease-associated alleles and the power to indirectly detect disease-association was investigated by Pritchard and Przeworski (2001). In a straight-forward derivation, it can be shown that the power to detect disease association indirectly at a marker locus in linkage disequilibrium with a disease-association locus is approximately the same as the power to detect disease-association directly at the disease-association locus if the sample size is increased by a factor of $$\frac{1}{r^2}$$

(the reciprocal of equation 18) at the marker in comparison with the disease-association locus.

Therefore, if one calculated the power to detect disease-association indirectly with an experiment having N samples, then equivalent power to directly detect disease-association (at the actual disease-susceptibility locus) would necessitate an experiment using approximately $r^2N$ samples. This elementary relationship between power, sample size and linkage disequilibrium can be used to derive an $r^2$ threshold value useful in determining whether or not genotyping markers in linkage disequilibrium with a SNP marker directly associated with disease status has enough power to indirectly detect disease-association.

To commence a derivation of the power to detect disease-associated markers through an indirect process, define the effective chromosomal sample size as $$n = \frac{4N_{cs}N_{ct}}{N_{cs}+N_{ct}}; \qquad (27)$$

where $N_{cs}$ and $N_{ct}$ are the numbers of diploid cases and controls, respectively. This is necessary to handle situations where the numbers of cases and controls are not equivalent. For equal case and control sample sizes, $N_{cs}=N_{ct}=N$, the value of the effective number of chromosomes is simply $n=2N$—as expected. Let power be calculated for a significance level $\alpha$ (such that traditional P-values below $\alpha$ will be deemed statistically significant). Define the standard Gaussian distribution function as $\Phi(\bullet)$. Mathematically, $$\Phi(x) = \frac{1}{\sqrt{2\pi}} \int_{-\infty}^{x} e^{-\frac{\theta^2}{2}} d\theta \qquad (28)$$

Alternatively, the following error function notation (Erf) may also be used, $$\Phi(x) = \frac{1}{2}\left[1 + \text{Erf}\left(\frac{x}{\sqrt{2}}\right)\right] \qquad (29)$$

For example, $\Phi(1.644854)=0.95$. The value of $r^2$ may be derived to yield a pre-specified minimum amount of power to detect disease association though indirect interrogation. Noting that the LD SNP marker could be the one that is carrying the disease-association allele, therefore that this approach constitutes a lower-bound model where all indirect power results are expected to be at least as large as those interrogated.

Denote by $\beta$ the error rate for not detecting truly disease-associated markers. Therefore, $1-\beta$ is the classical definition of statistical power. Substituting the Pritchard-Pzreworski result into the sample size, the power to detect disease association at a significance level of $\alpha$ is given by the approximation $$1 - \beta \cong \Phi\left[\frac{|q_{1,cs} - q_{1,ct}|}{\sqrt{\frac{q_{1,cs}(1-q_{1,cs}) + q_{1,ct}(1-q_{1,ct})}{r^2 n}}} - Z_{1-\alpha/2}\right]; \qquad (30)$$

where $Z_u$ is the inverse of the standard normal cumulative distribution evaluated at u ($u \in (0,1)$). $Z_u = \Phi^{-1}(u)$, where $\Phi(\Phi^{-1}))=\Phi^{-1}(\Phi)(u))=u$. For example, setting $\alpha=0.05$, and therefore $1-\alpha/2=0.975$, one obtains $Z_{0.975}=1.95996$. Next, setting power equal to a threshold of a minimum power of T, $$T = \Phi\left[\frac{|q_{1,cs} - q_{1,ct}|}{\sqrt{\frac{q_{1,cs}(1-q_{1,cs}) + q_{1,ct}(1-q_{1,ct})}{r^2 n}}} - Z_{1-\alpha/2}\right] \qquad (31)$$

and solving for $r^2$, the following threshold $r^2$ is obtained:

$$r_T^2 = \frac{[q_{1,cs}(1-q_{1,cs}) + q_{1,ct}(1-q_{1,ct})]}{n(q_{1,cs}-q_{1,ct})^2}[\Phi^{-1}(T) + Z_{1-\alpha/2}]^2 \quad (32)$$

Or, $$r_T^2 = \frac{(Z_T + Z_{1-\alpha/2})^2}{n}\left[\frac{q_{1,cs} - (q_{1,cs})^2 + q_{1,ct} - (q_{1,ct})^2}{(q_{1,cs}-q_{1,ct})^2}\right] \quad (33)$$

Suppose that $r^2$ is calculated between an interrogated SNP and a number of other SNPs with varying levels of LD with the interrogated SNP. The threshold value $r_T^2$ is the minimum value of linkage disequilibrium between the interrogated SNP and the potential LD SNPs such that the LD SNP still retains a power greater or equal to T for detecting disease-association. For example, suppose that SNP rs200 is genotyped in a case-control disease-association study and it is found to be associated with a disease phenotype. Further suppose that the minor allele frequency in 1,000 case chromosomes was found to be 16% in contrast with a minor allele frequency of 10% in 1,000 control chromosomes. Given those measurements one could have predicted, prior to the experiment, that the power to detect disease association at a significance level of 0.05 was quite high—approximately 98% using a test of allelic association. Applying equation (32) one can calculate a minimum value of $r^2$ to indirectly assess disease association assuming that the minor allele at SNP rs200 is truly disease-predisposing for a threshold level of power. If one sets the threshold level of power to be 80%, then $r_T^2$=0.489 given the same significance level and chromosome numbers as above. Hence, any SNP with a pairwise $r^2$ value with rs200 greater than 0.489 is expected to have greater than 80% power to detect the disease association. Further, this is assuming the conservative model where the LD SNP is disease-associated only through linkage disequilibrium with the interrogated SNP rs200.

Imputation

Genotypes of SNPs can be imputed without actually having to be directly genotyped (referred to as "imputation"), such as by using known haplotype information. Imputation is particularly useful for identifying disease associations for specific known but ungenotyped SNPs by imputing missing genotypes to these ungenotyped SNPs. Haplotype information (such as from the HapMap project by The International HapMap Consortium) can be used to infer haplotype phase and/or impute genotypes for known SNPs that are not directly genotyped in a given individual or sample set (such as for a disease association study). In general, imputation is based on using a reference dataset in which the genotypes of potential SNPs that are to be tested for disease association have been determined in multiple individuals (such as in HapMap), and then applying this reference dataset to infer haplotype phase and/or impute missing genotypes in additional individuals or samples for SNPs that have not been directly genotyped. The HapMap dataset is particularly useful as the reference dataset, however other datasets can be used. Haplotype phase can be determined based on LD and, since haplotypes can be correlated with other SNPs within a genomic region due to LD, ungenotyped SNPs can be tested for disease assocations (or other traits) by testing haplotypes or by imputing genotypes to the ungenotyped SNPs. The majority of methods used for haplotype phase inference can also be used to impute missing genotypes, however methods for imputing missing genotypes do not necessarily rely on haplotype phase inference (Browning, Hum Genet (2008) 124:439-450). Certain exemplary methods for haplotype phase inference and imputation of missing genotypes utilize the BEAGLE genetic analysis program.

Thus, SNPs for which genotypes are imputed can be tested for association with a disease or other trait even though these SNPs are not directly genotyped. The SNPs for which genotypes are imputed can be, for example, SNPs that have genotype data available in HapMap but that are not directly genotyped in a particular individual or sample set (such as in a particularly disease association study).

In addition to using a reference dataset (e.g., HapMap) to impute genotypes of SNPs that are not directly genotyped in a study, imputation can also be used to impute genotypes of SNPs that were directly genotyped in a study but for which the genotypes are missing for some reason such as because they failed to pass quality control, and imputation can also be used to combine genotyping results from multiple studies in which different sets of SNPs were genotyped. For example, genotyping results from multiple different studies can be combined, and genotypes can be imputed for SNPs that have been genotyped in some, but not all, of the studies (Browning, Hum Genet (2008) 124:439-450).

For a review of imputation (as well as the BEAGLE program), see Browning, "Missing data imputation and haplotype phase inference for genome-wide association studies", Hum Genet (2008) 124:439-450, incorporated herein by reference.

The contribution or association of particular SNPs and/or SNP haplotypes with disease phenotypes, such as psoriasis, enables the SNPs of the present invention to be used to develop superior diagnostic tests capable of identifying individuals who express a detectable trait, such as psoriasis, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with psoriasis might indicate a probability of 20% that an individual has or is at risk of developing psoriasis, whereas detection of five SNPs, each of which correlates with psoriasis, might indicate a probability of 80% that an individual has or is at risk of developing psoriasis. To further increase the accuracy of diagnosis or predisposition screening, analysis of the SNPs of the present invention can be combined with that of other polymorphisms or other risk factors of psoriasis, such as disease symptoms, pathological characteristics, family history, diet, environmental factors or lifestyle factors.

It will be understood by practitioners skilled in the treatment or diagnosis of psoriasis that the present invention generally does not intend to provide an absolute identification of individuals who are at risk (or less at risk) of developing psoriasis, and/or pathologies related to psoriasis, but rather to indicate a certain increased (or decreased) degree or likelihood of developing the disease based on statistically significant association results. However, this information is extremely valuable as it can be used to, for example, initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to psoriasis.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Therapeutics, Pharmacogenomics, and Drug Development

Therapeutic Methods and Compositions

In certain aspects of the invention, there are provided methods of assaying (i.e., testing) one or more SNPs provided by the present invention in an individual's nucleic acids, and administering a therapeutic or preventive agent to the individual based on the allele(s) present at the SNP(s) having indicated that the individual can benefit from the therapeutic or preventive agent.

In further aspects of the invention, there are provided methods of assaying one or more SNPs provided by the present invention in an individual's nucleic acids, and administering a diagnostic agent (e.g., an imaging agent), or otherwise carrying out further diagnostic procedures on the individual, based on the allele(s) present at the SNP(s) having indicated that the diagnostic agents or diagnostics procedures are justified in the individual.

In yet other aspects of the invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to an individual who has been tested for one or more SNPs provided by the present invention.

Pharmacogenomics

The present invention provides methods for assessing the pharmacogenomics of a subject harboring particular SNP alleles or haplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, *Nature* 405, 857-865 (2000); Gould Rothberg, *Nature Biotechnology* 19, 209-211 (2001); Eichelbaum, *Clin Exp Pharmacol Physiol* 23(10-11):983-985 (1996); and Linder, *Clin Chem* 43(2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in predicting an individual's predisposition to psoriasis and in predicting an individual's responsiveness to a drug (particularly for treating or preventing psoriasis). Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et al., Trends in Biotechnology, August 2000.). Thus, pharmacogenomics based on the SNPs disclosed herein has the potential to both save lives and reduce healthcare costs substantially.

Pharmacogenomics in general is discussed further in Rose et al., "Pharmacogenetic analysis of clinically relevant genetic polymorphisms," Methods Mol Med 85:225-37 (2003). Pharmacogenomics as it relates to Alzheimer's disease and other neurodegenerative disorders is discussed in Cacabelos, "Pharmacogenomics for the treatment of dementia," Ann Med 34(5):357-79 (2002); Maimone et al., "Pharmacogenomics of neurodegenerative diseases," Eur J Pharmacol 413(1):11-29 (February 2001); and Poirier, "Apolipoprotein E: a pharmacogenetic target for the treatment of Alzheimer's disease," Mol Diagn 4(4):335-41 (December1999). Pharmacogenomics as it relates to cardiovascular disorders is discussed in Siest et al., "Pharmacogenomics of drugs affecting the cardiovascular system," Clin Chem Lab Med 41(4):590-9 (April 2003); Mukherjee et al., "Pharmacogenomics in cardiovascular diseases," Prog Cardiovasc Dis 44(6):479-98 (May-June 2002); and Mooser et al., "Cardiovascular pharmacogenetics in the SNP era," J Thromb Haemost 1(7):1398-402 (July 2003). Pharmacogenomics as it relates to cancer is discussed in McLeod et al., "Cancer pharmacogenomics: SNPs, chips, and the individual patient," Cancer Invest 21(4):630-40 (2003); and Watters et al., "Cancer pharmacogenomics: current and future applications," Biochim Biophys Acta 1603(2):99-111 (March 2003).

Clinical Trials

In certain aspects of the invention, there are provided methods of using the SNPs disclosed herein to identify or stratify patient populations for clinical trials of a therapeutic, preventive, or diagnostic agent.

For instance, an aspect of the present invention includes selecting individuals for clinical trials based on their SNP genotype, such as selecting individuals for inclusion in a clinical trial and/or assigning individuals to a particular group within a clinical trial (e.g., an "arm" or "cohort" of the trial). For example, individuals with SNP genotypes that indicate that they are likely to positively respond to a drug can be included in the trials, whereas those individuals whose SNP genotypes indicate that they are less likely to or would not respond to the drug, or who are at risk for suffering toxic effects or other adverse reactions, can be excluded from the clinical trials. This not only can improve the safety of clinical trials, but also can enhance the chances that the trial will demonstrate statistically significant efficacy.

Thus, certain embodiments of the invention provide methods for conducting a clinical trial of a therapeutic agent in which a human is selected for inclusion in the clinical trial and/or assigned to a particular group within a clinical trial based on the presence or absence of one or more SNPs disclosed herein. In certain embodiments, the therapeutic agent is an agent that targets IL12 and/or IL23, such as an anti-IL12 or anti-IL23 antibody.

In certain exemplary embodiments, SNPs of the invention can be used to select individuals who are unlikely to respond positively to a particular therapeutic agent (or class of therapeutic agents) based on their SNP genotype(s) to participate in a clinical trial of another type of drug that may benefit them. Thus, in certain embodiments, the SNPs of the invention can be used to identify patient populations who do not adequately respond to current treatments and are therefore in need of new therapies. This not only benefits the patients themselves, but also benefits organizations such as pharmaceutical companies by enabling the identification of populations that represent markets for new drugs, and enables the efficacy of these new drugs to be tested during clinical trials directly in individuals within these markets.

The SNP-containing nucleic acid molecules of the present invention are also useful for monitoring the effectiveness of modulating compounds on the expression or activity of a variant gene, or encoded product, particularly in a treatment regimen or in clinical trials. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant.

Furthermore, the SNPs of the present invention may have utility in determining why certain previously developed drugs performed poorly in clinical trials and may help identify a subset of the population that would benefit from a drug that had previously performed poorly in clinical trials, thereby "rescuing" previously developed drugs, and enabling the drug to be made available to a particular psoriasis patient population that can benefit from it.

Identification, Screening, and Use of Therapeutic Agents

The SNPs of the present invention also can be used to identify novel therapeutic targets for psoriasis. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The invention further provides methods for identifying a compound or agent that can be used to treat psoriasis. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a psoriasis patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as psoriasis that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

Pharmaceutical Compositions and Administration Thereof

Any of the psoriasis-associated proteins, and encoding nucleic acid molecules, disclosed herein can be used as therapeutic targets (or directly used themselves as therapeutic compounds) for treating or preventing psoriasis or related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70-kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semisolid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in *Remington's Pharmaceutical Sciences* 18$^{th}$ ed., E.W. Martin, ed., Mack Publishing Company (1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80% wt.

Therapeutic compounds can be administered alone or in combination with other therapeutic compounds or in combination with one or more other active ingredient(s). For example, an inhibitor or stimulator of a psoriasis-associated protein can be administered in combination with another agent that inhibits or stimulates the activity of the same or a different psoriasis-associated protein to thereby counteract the effects of psoriasis.

For further information regarding pharmacology, see *Current Protocols in Pharmacology*, John Wiley & Sons, Inc., N.Y.

Nucleic Acid-Based Therapeutic Agents

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke, ed., Marcel Dekker, Inc., N.Y. (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates. See, e.g., Thompson, *Drug Discovery Today* 7(17): 912-917 (2002). Antisense oligonucleotides are directly useful as therapeutic agents, and are also useful for determining and validating gene function (e.g., in gene knock-out or knock-down experiments).

Antisense technology is further reviewed in: Lavery et al., "Antisense and RNAi: powerful tools in drug target discovery and validation," *Curr Opin Drug Discov Devel* 6(4): 561-9 (July 2003); Stephens et al., "Antisense oligonucleotide therapy in cancer," *Curr Opin Mol Ther* 5(2):118-22 (April 2003); Kurreck, "Antisense technologies. Improvement through novel chemical modifications," *Eur J Biochem* 270(8):1628-44 (April 2003); Dias et al., "Antisense oligonucleotides: basic concepts and mechanisms," *Mol Cancer Ther* 1(5):347-55 (March 2002); Chen, "Clinical development of antisense oligonucleotides as anti-cancer therapeutics," *Methods Mol Med* 75:621-36 (2003); Wang et al., "Antisense anticancer oligonucleotide therapeutics," *Curr Cancer Drug Targets* 1(3):177-96 (November 2001); and Bennett, "Efficiency of antisense oligonucleotide drug discovery," *Antisense Nucleic Acid Drug Dev* 12(3):215-24 (June 2002).

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as psoriasis, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs. Thompson, *Drug Discovery Today* 7(17): 912-917 (2002). Accordingly, an aspect of the present invention specifically contemplates isolated nucleic acid molecules that are about 18-26 nucleotides in length, preferably 19-25 nucleotides in length, and more preferably 20, 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference," *Nat Biotechnol* 22(3):326-30 (March 2004); Epub Feb. 1, 2004; Chi et al., "Genomewide view of gene silencing by small interfering RNAs," *PNAS* 100(11):6343-6346 (2003); Vickers et al., "Efficient Reduction of Target RNAs by Small Interfering RNA and RNase H-dependent Antisense Agents," *J Biol Chem* 278:7108-7118 (2003); Agami, "RNAi and related mechanisms and their potential use for therapy," *Curr Opin Chem Biol* 6(6):829-34 (December 2002); Lavery et al., "Antisense and RNAi: powerful tools in drug target discovery and validation," *Curr Opin Drug Discov Devel* 6(4):561-9 (July 2003); Shi, "Mammalian RNAi for the masses," *Trends Genet* 19(1):9-12 (January 2003); Shuey et al., "RNAi: gene-silencing in therapeutic intervention," *Drug Discovery Today* 7(20):1040-1046 (October 2002); McManus et al., *Nat Rev Genet* 3(10):737-47 (October 2002); Xia et al., *Nat Biotechnol* 20(10):1006-10 (October 2002); Plasterk et al., *Curr Opin Genet Dev* 10(5):562-7 (October 2000); Bosher et al., *Nat Cell Biol* 2(2):E31-6 (February 2000); and Hunter, *Curr Biol* 17; 9(12):R440-2 (June 1999).

Other Therapeutic Aspects

SNPs have many important uses in drug discovery, screening, and development, and thus the SNPs of the present invention are useful for improving many different aspects of the drug development process.

For example, a high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. Jazwinska, *A Trends Guide to Genetic Variation and Genomic Medicine* S30-S36 (March 2002).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants. Rothberg, *Nat Biotechnol* 19(3):209-11 (March 2001). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population. Jazwinska, *A Trends Guide to Genetic Variation and Genomic Medicine* S30-S36 (March 2002).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1 and 2, are useful in conjunction with a variety of toxicology methods established in the art, such as those set forth in *Current Protocols in Toxicology*, John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1 and 2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

A subject suffering from a pathological condition ascribed to a SNP, such as psoriasis, may be treated so as to correct the genetic defect. See Kren et al., *Proc Natl Acad Sci USA* 96:10349-10354 (1999). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

Human Identification Applications

In addition to their diagnostic, therapeutic, and preventive uses in psoriasis and related pathologies, the SNPs provided by the present invention are also useful as human identification markers for such applications as forensics, paternity testing, and biometrics. See, e.g., Gill, "An assessment of the utility of single nucleotide polymorphisms (SNPs) for forensic purposes," *Int J Legal Med* 114(4-5):204-10 (2001). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein.

For many of the SNPs disclosed in Tables 1 and 2 (which are identified as "Applera" SNP source), Tables 1 and 2 provide SNP allele frequencies obtained by re-sequencing the DNA of chromosomes from 39 individuals (Tables 1 and 2 also provide allele frequency information for "Celera" source SNPs and, where available, public SNPs from dbEST, HGBASE, and/or HGMD). The allele frequencies provided in Tables 1 and 2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1 and 2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1 and 2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1 and 2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1 and 2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry," *Journal of Forensic Sciences* 48(4):771-782 (2003).

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationally more stable than repeat polymorphisms. SNPs are not susceptible to artifacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium.

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms," *Electrophoresis* 20(8):1676-81 (June 1999).

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns. See, for example, O'Connor, *Stanford Technology Law Review*, and U.S. Pat. No. 6,119,096.

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact.

Further information regarding techniques for using SNPs in forensic/human identification applications can be found, for example, in *Current Protocols in Human Genetics* 14.1-14.7, John Wiley & Sons, N.Y. (2002).

Variant Proteins, Antibodies, Vectors, Host Cells, & Uses Thereof

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are referred to as SEQ ID NOS:3-4 in Table 1 and provided in the Sequence Listing. These variants will generally be referred to herein as variant proteins/peptides/polypeptides, or polymorphic proteins/peptides/polypeptides of the present invention. The terms "protein," "peptide," and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below. Sambrook and Russell, *Molecular Cloning: A Laboratory Manual*, Cold Spring Harbor Laboratory Press, N.Y. (2000).

The present invention provides isolated variant proteins that comprise, consist of or consist essentially of amino acid sequences that contain one or more variant amino acids encoded by one or more codons that contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence. See Ausubel et al., *Current Protocols in Molecular Biology* (1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems," *Appl Microbiol Biotechnol* 60(5):523-33 (January 2003); Epub Nov. 7, 2002; Graddis et al., "Designing proteins that work using recombinant technologies," *Curr Pharm Biotechnol* 3(4):285-97 (December 2002); and Nilsson et al., "Affinity fusion strategies for detection, purification, and immobilization of recombinant proteins," *Protein Expr Purif* 11(1):1-16 (October 1997).

In certain embodiments, novel compositions of the present invention also relate to further obvious variants of the variant polypeptides of the present invention, such as naturally-occurring mature forms (e.g., allelic variants), non-naturally occurring recombinantly-derived variants, and orthologs and paralogs of such proteins that share sequence homology. Such variants can readily be generated using art-known techniques in the fields of recombinant nucleic acid technology and protein biochemistry.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found, for example, in Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis, particularly using the amino acid sequence and polymorphism information provided in Table 1. Cunningham et al., *Science* 244:1081-1085 (1989). The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling. Smith et al., *J Mol Biol* 224:899-904 (1992); de Vos et al., *Science* 255:306-312 (1992).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Particularly common modifications, for example glycosylation, lipid attachment, sulfation, gamma-carboxylation of glutamic acid residues, hydroxylation and ADP-ribosylation, are described in most basic texts, such as *Proteins—Structure and Molecular Properties* 2nd Ed., T. E. Creighton, W. H. Freeman and Company, N.Y. (1993); F. Wold, *Posttranslational Covalent Modification of Proteins* 1-12, B. C. Johnson, ed., Academic Press, N.Y. (1983); Seifter et al., *Meth Enzymol* 182:626-646 (1990); and Rattan et al., *Ann NY Acad Sci* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis). *Current Protocols in Protein Science*, John Wiley & Sons, N.Y. (2002).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art. See, e.g., *Molecular Cloning: A Laboratory Manual*, Sambrook and Russell, Cold Spring Harbor Laboratory Press, N.Y. (2000), and *Methods in Enzymology: Guide to Molecular Cloning Techniques*, S. L. Berger and A. R. Kimmel, eds., Academic Press (1987).

In a specific embodiment of the invention, the methods of the present invention include detection of one or more variant proteins disclosed herein. Variant proteins are disclosed in Table 1 and in the Sequence Listing as SEQ ID NOS:3-4. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for diagnosing psoriasis or for determining predisposition to psoriasis in a human, for treating and/or preventing psoriasis, or for predicting an individual's response to a drug treatment (particularly treatment or prevention of psoriasis), etc. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with psoriasis that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays," *Anal Chem* 15; 71(12):294R-304R (June 1999).

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., Nature 354:82-84 (1991); Houghten et al., Nature 354: 84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., Cell 72:767-778 (1993)); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an end-point assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein. Hodgson, Bio/technology, 10(9), 973-80 (September 1992).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as psoriasis. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay to identify other proteins that bind to or interact with the variant protein and are involved in variant protein activity. See, e.g., U.S. Pat. No. 5,283,317; Zervos et al., Cell 72:223-232 (1993); Madura et al., J Biol Chem 268: 12046-12054 (1993); Bartel et al., Biotechniques 14:920-924 (1993); Iwabuchi et al., Oncogene 8:1693-1696 (1993); and Brent, WO 94/10300. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., Proc Natl Acad Sci USA 81:6851 (1984); Neuberger et al., Nature 312:604 (1984)), a humanized antibody (U.S. Pat. Nos. 5,693,762; 5,585,089 and 5,565, 332), a single-chain Fv (U.S. Pat. No. 4,946,778; Ward et al., Nature 334:544 (1989)), a bispecific antibody with two binding specificities (Segal et al., J Immunol Methods 248:1 (2001); Carter, J Immunol Methods 248:7 (2001)), a diabody, a triabody, and a tetrabody (Todorovska et al., J Immunol Methods 248:47 (2001)), as well as a Fab conjugate (dimer or trimer), and a minibody.

Many methods are known in the art for generating and/or identifying antibodies to a given target antigen. Harlow, Antibodies, Cold Spring Harbor Press, N.Y. (1989). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology, which immortalizes cells secreting a specific monoclonal antibody. Kohler and Milstein, *Nature* 256:495 (1975). The immortalized cell lines can be created in vitro by fusing two different cell types, typically lymphocytes, and tumor cells. The hybridoma cells may be cultivated in vitro or in vivo. Additionally, fully human antibodies can be generated by transgenic animals. He et al., *J Immunol* 169:595 (2002). Fd phage and Fd phagemid technologies may be used to generate and select recombinant antibodies in vitro. Hoogenboom and Chames, *Immunol Today* 21:371 (2000); Liu et al., *J Mol Biol* 315:1063 (2002). The complementarity-determining regions of an antibody can be identified, and synthetic peptides corresponding to such regions may be used to mediate antigen binding. U.S. Pat. No. 5,637,677.

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

Antibodies, particularly the use of antibodies as therapeutic agents, are reviewed in: Morgan, "Antibody therapy for Alzheimer's disease," *Expert Rev Vaccines* (1):53-9 (February 2003); Ross et al., "Anticancer antibodies," *Am J Clin Pathol* 119(4):472-85 (April 2003); Goldenberg, "Advancing role of radiolabeled antibodies in the therapy of cancer," *Cancer Immunol Immunother* 52(5):281-96 (May 2003); Epub Mar. 11, 2003; Ross et al., "Antibody-based therapeutics in oncology," *Expert Rev Anticancer Ther* 3(1):107-21 (February 2003); Cao et al., "Bispecific antibody conjugates in therapeutics," *Adv Drug Deliv Rev* 55(2):171-97 (February 2003); von Mehren et al., "Monoclonal antibody therapy for cancer," *Annu Rev Med* 54:343-69 (2003); Epub Dec. 3, 2001; Hudson et al., "Engineered antibodies," *Nat Med* 9(1):129-34 (January 2003); Brekke et al., "Therapeutic antibodies for human diseases at the dawn of the twenty-first century," *Nat Rev Drug Discov* 2(1):52-62 (January 2003); Erratum in: *Nat Rev Drug Discov* 2(3):240 (March 2003); Houdebine, "Antibody manufacture in transgenic animals and comparisons with other systems," *Curr Opin Biotechnol* 13(6):625-9 (December 2002); Andreakos et al., "Monoclonal antibodies in immune and inflammatory diseases," *Curr Opin Biotechnol* 13(6):615-20 (December 2002); Kellermann et al., "Antibody discovery: the use of transgenic mice to generate human monoclonal antibodies for therapeutics," *Curr Opin Biotechnol* 13(6):593-7 (December 2002); Pini et al., "Phage display and colony filter screening for high-throughput selection of antibody libraries," *Comb Chem High Throughput Screen* 5(7):503-10 (November 2002); Batra et al., "Pharmacokinetics and biodistribution of genetically engineered antibodies," *Curr Opin Biotechnol* 13(6):603-8 (December 2002); and Tangri et al., "Rationally engineered proteins or antibodies with absent or reduced immunogenicity," *Curr Med Chem* 9(24):2191-9 (December 2002).

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as in psoriasis, or during drug treatment. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, such as psoriasis, or during the course of a treatment regime. Antibodies specific for a variant protein encoded by a SNP-containing nucleic acid molecule of the present invention can be used to assay for the presence of the variant protein, such as to diagnose psoriasis or to predict an individual's response to a drug treatment or predisposition/susceptibility to psoriasis, as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol. Leong et al., *Cytokine* 16:106 (2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors. See, e.g., Sambrook and Russell, *Molecular Cloning: A Laboratory Manual*, Cold Spring Harbor Laboratory Press, N.Y. (2000).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, *Molecular Cloning: A Laboratory Manual*, Cold Spring Harbor Laboratory Press, N.Y. (2000).

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *Escherichia coli, Streptomyces* spp., and *Salmonella typhimurium*. Eukaryotic host cells include, but are not limited to, yeast, insect cells such as *Drosophila* spp., animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-315 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (S. Gottesman, *Gene Expression Technology: Methods in Enzymology* 185:119-128, Academic Press, Calif. (1990)). Alternatively, the sequence of the SNP-containing nucleic acid molecule of interest can be altered to provide preferential codon usage for a specific host cell, for example, *E. coli*. Wada et al., *Nucleic Acids Res* 20:2111-2118 (1992).

The SNP-containing nucleic acid molecules can also be expressed by expression vectors that are operative in yeast. Examples of vectors for expression in yeast (e.g., *S. cerevisiae*) include pYepSec1 (Baldari et al., *EMBO J* 6:229-234 (1987)), pMFa (Kurjan et al., *Cell* 30:933-943 (1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol Cell Biol* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (B. Seed, *Nature* 329:840(1987)) and pMT2PC (Kaufman et al., *EMBO J* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, *Molecular Cloning: A Laboratory Manual*, Cold Spring Harbor Laboratory, Cold Spring Harbor Laboratory Press, N.Y. (2000).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence (s) can be operably linked to the transgene to direct expression of the variant protein in particular cells or tissues.

Methods for generating transgenic animals via embryo manipulation and microinjection, particularly animals such as mice, have become conventional in the art and are described, for example, in U.S. Pat. Nos. 4,736,866 and 4,870,009, both by Leder et al.; U.S. Pat. No. 4,873,191 by Wagner et al., and in B. Hogan, *Manipulating the Mouse Embryo*, Cold Spring Harbor Laboratory Press, N.Y. (1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1. Lakso et al., *PNAS* 89:6232-6236 (1992). Another example of a recombinase system is the FLP recombinase system of *S. cerevisiae*. O'Gorman et al., *Science* 251:1351-1355 (1991). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described, for example, in I. Wilmut et al., *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context.

Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems," *Curr Opin Biotechnol* 13(6):625-9 (December 2002); Petters et al., "Transgenic animals as models for human disease," *Transgenic Res* 9(4-5):347-51, discussion 345-6 (2000); Wolf et al., "Use of transgenic animals in understanding molecular mechanisms of toxicity," *J Pharm Pharmacol* 50(6):567-74 (June 1998); Echelard, "Recombinant protein production in transgenic animals," *Curr Opin Biotechnol* 7(5):536-40 (October 1996); Houdebine, "Transgenic animal bioreactors," *Transgenic Res* 9(4-5):305-20 (2000); Pirity et al., "Embryonic stem cells, creating transgenic animals," *Methods Cell Biol* 57:279-93 (1998); and Robl et al., "Artificial chromosome vectors and expression of complex proteins in transgenic animals," *Theriogenology* 59(1):107-13 (January 2003).

EXAMPLES

The following examples are offered to illustrate, but not limit, the claimed invention.

Example 1: Identification and Analysis of Haplotypes in the IL23R Region Associated with Psoriasis Overview To analyze the association of IL23R with psoriasis, a fine mapping strategy was used to identify 59 additional IL23R-linked SNPs which were genotyped in three independent, white North American sample sets (>2800 individuals in toto). A sliding window of haplotype association demonstrates co-localization of psoriasis susceptibility effects within the boundaries of IL23R across all sample sets, thereby decreasing the likelihood that neighboring genes, particularly IL12RB2, are driving the association at this region. Additional haplotype work identified two 5-SNP haplotypes with strong protective effects, consistent across the three sample sets ($OR_{common}$=0.67; $P_{comb}$=4.32E-07). Importantly, heterogeneity of effect was extremely low between sample sets for these haplotypes ($P_{Het}$=0.961). Together, these protective haplotypes attain a frequency of 16% in controls, declining to 11% in cases. The characterization of association patterns within IL23R to specific predisposing/protective variants enables uses of IL23R variants for determining an individual's risk for developing psoriasis (as well as related pathologies such as Crohn's disease) and for predicting an individual's response to various pharmaceutical therapies and dosages, as well as other uses.

Results

Genotyping for this study was performed on three independent sample sets consisting of white North American psoriasis cases and controls, totaling 1444 cases and 1382 controls. Basic demographic and clinical characteristics of these sample sets are described in a previous publication.[2] A type of genomic-control analysis was performed on pooled genotype data from the initial sample set which effectively ruled out large population stratification effects.[2]

Applying a fine mapping SNP selection algorithm (described in the "Materials and Methods" section of Example 1 below), 59 additional SNPs were identified for interrogation in the three sample sets, for a total of 61 SNPs covering 338 kb (rs7530511, P310L; and rs11209026, R381Q were previously genotyped in all three sample sets). 31 of these fine mapping SNPs were within the coding region or the 3'UTR of IL23R.

Of the 61 SNPs evaluated, eight had Mantel-Haenszel continuity-corrected P-values (MH P-values combine association evidence across the three samples sets, accounting for direction of effect) below 0.05 (data not shown). Allele frequencies, genotypic 2-df P-values and P-values for the exact test of Hardy-Weinberg equilibrium for each sample set were also determined for these SNPs, as well as Mantel-Haenszel allelic odds ratio and 95% confidence intervals (which were calculated jointly across the three sample sets) (data not shown). Six of these eight significant SNPs reside within the IL23R coding region and the remaining two are located in the intergenic region between IL23R and IL12RB2. These eight SNPs include two previously reported missense SNPs, rs7530511 (P310L) and rs11209026 (R381Q).

Prior to tests of haplotype association, two types of graphical representations of linkage disequilibrium patterns were constructed: To characterize the pairwise correlation structure for the entire 338 kb region, a heatmap for cases and controls combined using the $r^2$ and D' statistics was generated (not shown). Individual pairwise LD values with corresponding SNPs were calculated (data not shown). All three sample sets were combined for this analysis. The $r^2$ heatmap showed an absence of solid block patterns. Rather, there are two very roughly-defined block structures in the region with slightly higher average $r^2$ values than the surrounding regions. These weak blocks are highly peppered with pairwise comparisons of low LD. More pronounced LD structure is displayed in the D' heatmap, with two or three blocks covering the region. Given the fine mapping SNP selection procedure employed where SNPs were genotyped if they exhibited high LD (as measured by $r^2$) with one of the originally associated missense SNPs (P310L or R381Q) and other SNPs were tagging SNPs reducing redundancy, the observance of strong block structures was unexpected. From the $r^2$ data, the first weak block extends roughly from intron 3 of C1orf141 into the 5' region of IL12RB2 and the second weak block covers part of the first intron of IL12RB2 through 28 kb 5' of SERBP1.

Because much of the association signal was driven by rs11209026 (R381Q) and other studies have identified this mis sense polymorphism as being strongly associated with the related phenotypes studied, the Mantel-Haenzsel P-value (combining the three sample sets) was plotted as a function of $r^2$ with R381Q (not shown). Under a model where R381Q is solely and causally responsible for the association patterns observed, one would expect the approximate relationship: $\log P_M \approx r^2 \log P_D$; where $P_M$ is the association P-value at a marker in linkage disequilibrium with the causative site, $P_D$ is the association P-value at the causative site, in this case R381Q, $r^2$ is the pairwise LD measure between the two sites and equal numbers of genotypes are assayed at each site. This association decay analysis suggests that some SNPs in low LD with R381Q may independently contribute to disease status as they substantially depart from the expected relationship.

In a previous publication, haplotypes for P310L and R381Q were constructed since haplotype association tests can be more informative than single marker test under many models where cis-effects play an important role.[34] Even though these SNPs were not in high LD, the number of double heterozygotes was small and hence linkage phase is unambiguous in the large majority of individuals. With these two missense polymorphisms, carrying the proline-arginine polypeptide-encoding gene shows susceptible effects whereas both the leucine-arginine and proline-glutamine polypeptides confer protective effects. For this study, the fine mapping data was used to scan this region positionally for haplotype effects using a sliding window approach. A window size of three adjacent SNPs was used. A positional plot of the global haplotype P-value for each window was generated (not shown). The plot showed an analysis combined across sample sets using the Fisher's combined P-value method. The results indicated rather narrow peaks of association centering on IL23R intron 8 through intron 9 and including the R381Q polymorphism in exon 9—a span of 12 kb. Four SNPs generated this association signal: rs10789229, rs10889671, rs11209026 (R381Q), and rs10889674; with the first window (rs10789229-rs10889671-rs11209026) producing a combined global P-value (2-tailed in each sample set) of 1.28E-04 and the second window (rs10889671-rs11209026-rs10889674) producing a combined global P-value (also 2-tailed in each sample set) of 6.42E-05. Through the association and LD analyses, it was apparent that although these four IL23R SNPs generated the peak association signal, additional psoriasis-association effects may be possible through haplotypes derived from additional SNPs (e.g., P310L). Analysis of pairwise LD and association results indicates that within the eight SNPs having significant Mantel-Haenszel P-values, rs7530511 is highly correlated with rs10889671 (intron 8, IL23R SNP; $r^2$=0.943); and similarly, rs11209026 is highly correlated with rs11465804 (intron 8, IL23R SNP; $r^2$=0.852). These data were then interrogated with several subsequent haplotype analyses.

Another haplotype-based investigation was commenced by using the five SNPs that exhibited the strongest and most consistent single-SNP association signals: rs7530511, rs11465804, rs10889671, rs11209026 and rs1857292. These SNPs span 53 kb from exon 7 in IL23R to the intergenic region between IL23R and IL12RB2. The five-SNP haplotypes were estimated and tested for association in the three sample sets. Five primary haplotypes were found (above 1% frequency), two of which conferred significant protection against psoriasis susceptibility (Table 5). Together, these two (completely divergent) protective haplotypes, TTAGT and CGGAA, were present on 16% of control chromosomes, decreasing to 11% in cases. The effect of these protective haplotypes was consistent across sample sets ($OR_{SS1}$=0.66, $OR_{SS2}$=0.67, $OR_{SS3}$=0.69), and the combined analysis was rather significant ($P_{MH}$=4.32E-07). Importantly, the level of heterogeneity of effect was not significant across sample sets for the protective haplotype grouping of TTAGT and CGGAA versus all other haplotypes ($P_{Het}$=0.961) as determined from the Mantel-Haenszel procedure to test odds ratios for homogeneity (see the "Materials and Methods" section of Example 1 below).

All possible combinations of these five SNPs were then systematically evaluated in an exploratory analysis to see if one or more of these SNPs could be eliminated while retaining or increasing the significance of the association result Eliminating rs11465804 and rs1857292 from the haplotypes yielded a simpler, slightly stronger association result for the protective haplotypes (TAG and CGA vs. Others; $P_{MH}$=3.88E-08) (Table 6) (although stochastic effects may not be ruled out). Without these two SNPs, the frequencies of the resulting protective haplotypes increased to 20% in controls and 14% in cases.

To better understand the physical extent of the protective haplotypes in this region, the haplotype analysis was expanded to include all contiguous markers such that the association signal was not substantially diminished by estimated historical recombination events. This region appeared to extend 55 kb from P310L through the 3' region of IL23R to rs11209032 in the IL23R-IL12RB2 intergenic region. Haplotype analysis was performed on all twenty-three markers in this region (Table 7). Again, two common protective haplotypes were identified. Although the initial five- and three-marker protective haplotypes described above did not share alleles at any sites, the two protective haplotypes from the twenty-three marker analysis had twelve markers with the same alleles on both haplotypes. As no other common (>1%) haplotypes shared the alleles at these twelve markers, the analysis was reduced to those twelve markers and another haplotype analysis was carried out (Table 8). Notably, the protective haplotype from this reduced set of SNPs, AGTTCCTCCCAG, carries substantial effects (freq in cases=12%, freq in controls=17%; $OR_{MH}$=0.68; $P_{MH}$=3.18E-07) and does not include P310L, R381Q or SNPs in high LD with these two missense SNPs (rs10889671, rs1857292, or rs11465804). In addition, this haplotype is remarkably similar in frequency and effect size across all three sample sets (in the case for the three marker haplotype rs7530511-rs10889671-rs11209026 described previously, the TAG haplotype exhibited the strongest protective effects in the Utah population-derived Sample Set 1 while the CGA haplotype was stronger in the remaining two sample sets which were derived from the North American white population in general).

To determine whether or not this 12-marker haplotype represents a variant contributing to psoriasis association independently of P310L and R381Q, the 12-marker haplotypes were dichotomized into the protective haplotype described above and an aggregate of all other haplotypes, and then the same was done for the rs7530511-rs11209026 haplotypes (TG and CA protective haplotypes combined together vs. CG and TA combined together). A diplotype-based, squared correlation coefficient $r^2$ statistic was then calculated between the two haplotype groupings. All individuals were used across all sample sets for this calculation. The resulting value, $r^2$=0.78, indicated a fairly high degree of correlation between the two diplotype groupings, thereby suggesting that although they were not completely redundant, these were not independent effects.

The LD patterns and haplotype results appear to indicate that more than one polymorphism is contributing to the psoriasis association linked to IL23R. To formally investigate this, a test of conditional association was performed on SNPs having the most significant combined P-values (P<0.005) for the 2df genotype test and exhibiting significant Mantel-Haenszel confidence intervals (95% CI excluding 1.0) for the allelic OR jointly calculated over the three sample sets. As some of these SNPs clustered into "LD groups" consisting of SNPs in very high LD and similar statistical significance for psoriasis association, a representative SNP was selected from each LD group when appropriate. Six SNPs met these criteria: the missense SNPs rs7520511 (P310L) and rs11209026 (R381Q), rs10889674 (putative transcription factor binding site, intron 9 IL23R), rs1857292 (3' of IL23R), rs11465804 (intron 8 of IL23R) and rs10889671 (intron 8 IL23R). Rs11465804 and rs10889671 were excluded from this analysis due to high LD with one of the missense SNPs (rs10889671-rs7530511 $r^2$=0.943; rs11465804-rs11209026 $r^2$=0.852) and since both missense SNPs had slightly elevated significance when compared to these LD counterparts. The conditional association permutation test revealed that the genotype association at R381Q remained significant after fixing the genotypes at P310L ($P_{comb}$=0.00031), or either of the remaining two SNPs ($P_{comb}$=0.0183, fixing genotypes at rs10889674; $P_{comb}$=0.0027, fixing genotypes at rs1857292). Conversely, the genotype association at P310L was also significant, albeit mildly so, following conditioning on R381Q genotypes ($P_{comb}$=0.0299); however the moderate LD between P310L and the other two SNPs removed the association at P310L. These results for the mutually conditionally independent association of the two missense SNPs were not unexpected given the very low amount of LD between these two SNPs. Hence, there is some evidence of at least two IL23R-linked polymorphisms independently contributing to psoriasis.

As other SNPs, not genotyped in this study, could possibly drive the association results observed here, the HapMap LD results were investigated for the CEU samples between genomic positions 67,225,114-67,725,113 on Build36.[35] Examining four key SNPs from this study, rs7530511, rs10889671, rs11465804, and rs11209026, seven SNPs were found to be in substantial LD ($r^2$>0.50) with either rs7530511, rs10889671 or both: rs2863212 (IL23R intron 6), rs7528924 (IL23R intron 7), rs4655692 (IL23R intron 7), rs4655693 (IL23R intron 7), rs11804284 (IL23R intron 7), rs4655530 (IL23R intron 8), and rs2863209 (intragenic, within 8 kb 3' of IL23R). The remaining two SNPs were only in substantial LD with each other ($r^2$ $rs_{11465804\text{-}rs11209026}$=0.852).

Discussion

Fine mapping of the IL23R-linked region shows variants segregating at IL23R coding and flanking regions significantly associated with psoriasis. In particular, there are extended haplotypes in this region that protect against psoriasis susceptibility. Importantly, it also appears that at least two IL23R polymorphisms, P310L and R381Q, independently contribute to linkage disequilibrium with the psoriasis phenotype. In addition, both sliding window haplotype analyses and longer-range haplotype work pinpointed the association signal to the IL23R coding region. This is particularly important as the interleukin 12 receptor subunit-encoding gene, IL12RB2, is located 47 kb from the 3' end of IL23R and some SNP pairs exhibit substantial and even perfect linkage disequilibrium between sites located in the coding regions of the two genes (as determined by genotyping in the CEU HapMap samples). Recent animal studies show that the IL12RB2 knockout mouse develops an autoimmune/lymphoproliferative disorder with aberrant IL-12 signaling.[36] Hence, IL12RB2 is a reasonable psoriasis candidate gene. However, the genetic results presented here seriously diminish the possibility that IL12RB2 alleles are primarily responsible for the observed psoriasis predisposing effects.

The HapMap project has general population genotype data on both missense SNPs, rs7530511 (P310L) and rs11209026 (R381Q).[35] At rs11209026, the A allele (minor allele) was found on CEU and YRI chromosomes (8 out of 120 CEU chromosomes and 2 out of 120 YRI chromosomes), but not on chromosomes from the two East Asian samples (CHB and JPT). Hence, it is possible that rs11209026 may predispose some African and/or African-derived populations to autoimmunity and autoinflammatory traits, particularly if the effect size is larger in those subpopulations than European-derived samples. The rs7530511 SNP is polymorphic in all four HapMap sample sets, with varying frequencies: 15/120 CEU chromosomes, 2/90 CHB chromosomes, 3/88 JPT chromosomes, and 35/118 YRI chromosomes; thereby suggesting that the autoinflammatory effects ascribed to P310L for the North American white samples might translate to these other populations. For each of these SNPs, the minor allele in humans appears to be derived, as many vertebrates including the chimpanzee, macaque, mouse, rat, cow, dog and chicken carry the major allele nucleotides at the orthologous sites.

These genetic findings coupled with results from multiple areas of research ranging from molecular immunology to clinical biology implicate the IL-23/$T_H$-17 pathway as being central to chronic inflammatory conditions such as psoriasis and inflammatory bowel disease; the perturbation of which may disrupt the communication between the innate and adaptive immune responses. In sum, these studies demonstrate several key aspects of IL-23/$T_H$-17 pathobiology related to psoriasis: 1) Both IL-12p40 and IL-23p19 mRNA expression levels are significantly elevated in both non-lesional psoriatic skin versus normal skin as well as lesional psoriatic skin versus non-lesional psoriatic skin.[37,38] 2) IL-12 and IL-23 knockouts and IL23-deficient animal model experiments indicate that the systemic inflammatory effects, dermal inflammation and epidermal hyperplasia are often mediated through the IL-23/$T_H$-17 pathway[38,39], 3) $T_H$17 survival and expansion, key characteristics of epithelial inflammation and epidermal hyperplasia, occur in response to IL-23[40-42] 4) IL-23p19 antibodies inhibit proinflammatory cytokines in a mouse model of IBD[43], and 5) clinical studies have shown dramatic efficacy of IL-12p40 antibodies in reducing symptoms in a high percentage of psoriatic subjects[44,45] and those with active Crohn's disease.[46] These diverse studies have conspired to highlight the central function of the IL-23/$T_H$-17 axis in mediating chronic inflammatory disease pathogenesis, downplaying the role of IL-12. Hence, full genetic description of both IL12B and IL23R, genes encoding for critical proteins in the IL-23/$T_H$-17 response, enables delineation of specific variants predisposing and protective of disease and facilitates a further understanding of the molecular pathobiology of autoinflammatory phenotypes.

Along with psoriasis, IL23R appears to play an important role in predisposition to other autoinflammatory diseases including IBD (particularly adult and pediatric Crohn's disease)[16-24], AS[25,26], and GO.[27] IL23R variants may also underlie susceptibility to celiac disease[28], Graves' disease without ophthalmopathy[27] and multiple sclerosis[25,28,29,30,31] Interestingly, multiple independent IL23R polymorphisms have been reported to be associated with AS, GO and Crohn's disease, suggesting a model of allelic heterogeneity within each disease where disruption of IL-23R function can occur from several distinct genetic insults. With AS, both R381Q and rs1343151 are replicated SNPs (R381Q was associated with psoriasis in this study). Two IL23R SNPs, rs2201841 and rs10889677, are associated with GO, and P310L may be associated with Graves' disease. R381Q may be the major IL23R susceptibility polymorphism for Crohn's disease with the minor allele conferring protective effects as in psoriasis. rs7517847 plays a role in Crohn's disease, and P310L appears to be significantly correlated with psoriasis.

The IL23R variants described herein have uses related to targeted therapeutics, such as the efficacious IL12/23 monoclonal antibodies[44-46], and in autoinflammatory pharmacogenetics, for example.

Materials and Methods

Subjects

The subjects in all three sample sets were white North American individuals. Sample Set 1 (also referred to herein as "S0048") consisted of 467 psoriasis cases and 500 controls, all residing in either Utah or southern Idaho. Sample Set 2 (also referred to herein as "50056A") was obtained by the Genomics Collaborative Division of SeraCare Life Sciences (GCI) and included 498 cases and 498 controls. Lastly, BioCollections Worldwide and GCI provided Sample Set 3 (also referred to herein as "A0019"), composed of 481 cases and 424 controls. Details concerning these subjects were previously described.[11] All individuals included in this study were 18 years or older at time of enrollment. All protocols were approved by national and/or local institutional review boards, and informed written consent was obtained from all subjects.

Genotyping

Individual genotyping was performed using allele-specific kinetic PCR on 0.3 ng of DNA and the resulting data hand-curated prior to statistical analyses without knowledge of case/control status. Genotyping accuracy of the laboratory is consistently better than 99%.[11]

SNP Selection

A multifaceted approach was undertaken to identify SNPs to genotype individually in a fine-scale mapping effort in the IL23R region. A 336 kbp region was selected across a portion of C1orf141 through SERBP1. This region was delineated on the basis of two criteria: 1) the decay of LD from the two IL23R SNPs, rs7530511 and rs11209026, originally identified to be associated in the sample sets[11], and 2) coverage of clear biological candidate genes nearby—in this case, IL23R and IL12RB2. Next, SNPs were selected in this 336kbp region to cover two genetic models: one of allelic heterogeneity where multiple variants segregating at the same gene or functional motif independently contribute to disease predisposition; and the second model where the association observed at the originally-identified SNPs, rs7530511 and rs11209026, was driven through LD with one or more untyped polymorphisms. To address these two possible models, SNPs were partitioned in the 336kbp region into those in moderate to high LD ($r^2>0.20$) with one of the original two associated SNPs, and those exhibiting weak LD with the original SNPs ($r^2<0.20$). The threshold value of $r^2=0.20$ was determined analytically by solving for the $r^2$ value that would generate the observed results at these two original SNPs from an untyped marker having a reasonable disease model (relative risk below 2.25 with similar allele frequency). The $r^2$ values were calculated from the HapMap CEU data.[35] Next, the tagging SNP program Redigo[47] was ran on those SNPs in weak LD, selecting SNPs with the highest power to detect an arbitrary disease predisposing site in the region. Redigo uses a genotype-based approach that maximizes power to detect disease susceptibility SNPs. All of the SNPs in the moderate-to-high LD group were then selected and this set was reduced so that SNPs in extremely high LD ($r^2>0.97$) were represented by a single SNP. Lastly, any SNP with putative functional annotation was selected to be genotyped. In all, 61 SNPs, inclusive of the two SNPs fully genotyped in the original study, were identified and judged as being sufficient to cover both genetic models for the IL23R region.

Statistical Analysis

Several analyses were performed on individual SNPs. An in-house genetic analysis application was used to analyze much of the data. Hardy-Weinberg equilibrium testing was accomplished through the exact test of Weir.[48] A William's-corrected G-test was used to calculate P-values for genotypic association.[49] Approximate confidence intervals for the odds ratios were calculated using the typical estimate of the standard error of the log-odds ratio. The Mantel-Haenszel procedure to test odds ratios for homogeneity (test of heterogeneity of effect) was performed following Sokal and Rohlf (Chapter 17, Reference 49). P-values were combined across sample sets using either the continuity-corrected Mantel-Haenszel statistic (eqn 17.22, reference 49) or the Fisher's combined P-value (omnibus procedure).[50] Similarly, Mantel-Haenszel common odds ratios were calculated to combine data across sample sets.[51] A Monte Carlo simulation was written in XLISP-STAT to calculate 95% confidence intervals on the common odds ratios. Typically, 20,000 iterations of the Monte Carlo were performed unless results were not sufficiently converging, in which case 40,000 iterations were used.

Pairwise linkage disequilibrium was calculated using either the LDMax package where 2-SNP haplotypes were estimated through an EM algorithm and the standard $r^2$ statistic employed,[52,53] or, in some instances, an $r^2$ statistic was calculated using unphased genotype or diplotype data. Given perfect phasing for the double heterozygotes and Hardy-Weinberg Equilibrium, these two methods yield identical values.

Sliding window haplotype association tests were performed by running Haplo.Stats[54] sequentially on adjacent sets of three SNPs. Plots of the global P-values from each window were plotted against the average position of the SNPs in the window. Additional haplotype and diplotype work was performed using the Pseudo-Gibbs sampling algorithm from the SNPAnalyzer program[55] to estimate phase, followed by a William's-corrected G test of homogeneity.

Similar to the haplotype method[56], a test of pairwise conditional independence (i.e., fixing the genotypes at one SNP and testing for the association at a second SNP) was performed through a permutation routine where case/control status is permuted against genotype data to generate a null distribution. For conditional independence hypotheses concerning only a small number of highly significant SNPs driving correlated SNPs to association solely through LD (such as is the case here), a permutation method has advantages over logistic regression models in that the P-values, given a sufficient number of iterations, will be appropriate regardless of LD levels, effect size and counts. Alternatively, logistic regression-based methods are preferred in situations that warrant inclusion of many SNPs and/or covariates with low to moderate LD/correlation levels and/or the hypothesis tested requires adjustment to be performed on more than one SNP. Typically, 2,000 iterations of the permutation were performed and P-values were calculated through a modeling procedure where a log-likelihood ratio test statistic is calculated for each of the permuted iterations. Next, the parameters of a gamma probability density are estimated from the permuted log-likelihood ratio test statistics and a P-value is calculated by integrating this null density from the observed log-likelihood ratio statistic. For a given number of permutation iterations, this modeling procedure gives more accurate P-values than simply taking the frequency of those permuted iterations that exceed the observed value.

Related Material Incorporated Herein by Reference

Garcia et al., "Detailed genetic characterization of the interleukin-23 receptor in psoriasis", *Genes Immun.* 2008 September; 9(6):546-55; U.S. patent application Ser. No. 11/899,017, filed Aug. 31, 2007 (Begovich et al.); and Cargill et al., "A large-scale genetic association study confirms IL12B and leads to the identification of IL23R as psoriasis risk genes", *Am J Hum Genet.* 2007 February; 80(2):273-90, which describe the same sample sets as used here in Example 1, are each incorporated herein by reference in their entirety.

REFERENCES

1. Chan J R, Blumenschein W, Murphy E, Diveu C, Wiekowski M, Abbondanzo S, et al. IL-23 stimulates epidermal hyperplasia via TNF and IL-20R2-dependent mechanisms with implications for psoriasis pathogenesis. *J Exp Med* 2006; 203:2577-2587.
2. Neimann A L, Porter S B, Gelfand J M. The epidemiology of psoriasis. *Expert Rev Dermatol* 2006; 1: 63-75.
3. Kremers H M, McEvoy M T, Dann F J, Gabriel S E. Heart disease in psoriasis. *J Am Acad Dermatol* 2007; 57:347-354.
4. Griffiths C E M, Barker J N Pathogenesis and clinical features of psoriasis. *The Lancet* 2007; 370:263-271.
5. Farber E M, Nall M L, Watson W. *Arch Dermatol* 1974; 109:207-211.
6. Nair R P, Stuart P E, Nistor I, Hiremagalore R, Chia N V, Jenisch S et al. Sequence and haplotype analysis supports HLA-C as the psoriasis susceptibility 1 gene. *Am J Hum Genet* 2006; 78:827-851.
7. Helms C, Cao L, Krueger J G, Wijsman E M, Chamain F, Gordon D, et al. A putative RUNX1 binding site variant between SLC9A3R1 and NAT9 is associated with susceptibility to psoriasis. 2003; *Nat Genet* 35:349-356.
8. Capon F, Helms C, Veal C D, Tillman D, Burden A D, Barker J N, et al. Genetic analysis of PSORS2 markers in a UK dataset supports the association between RAPTOR SNPs and familial psoriasis. 2004; *J Med Genet* 41:459-460.
9. Stewart P, Nair R P, Abecasis G R, Nistor I, Hiremagalore R, Chia N V, et al. Analysis of RUNX1 binding site and RAPTOR polymorphisms in psoriasis: no evidence for association despite adequate power and evidence for linkage. 2006; *J Med Genet* 43:12-17.
10. Tsunemi Y, Saeki H, Nakamura K, Sekiya T, Hirai K, Fujita H, et al. Interleukin-12 p40 gene (IL12B) 3'-untranslated region polymorphism is associated with susceptibility to atopic dermatitis and psoriasis vulgaris. *J Dermatol Sci* 2002; 302:161-166.
11. Cargill M, Schrodi S J, Chang M, Garcia V E, Brandon R, Callis K P, et al. A large-scale genetic association study confirms IL12B and leads to the identification of IL23R as psoriasis-risk genes. *Am J Hum Genet* 2007; 80:273-290.
12. Capon F, DiMeglio P, Szaub J, Prescott N J, Dunster C, Baumber L, et al. Sequence variants in the genes for the interleukin-23 receptor (IL23R) and its ligand (IL12B) confer protection against psoriasis. *Hum Genet* 2007; 122:201-206.
13. Smith R L, Warren R B, Eyre S, Ho P, Ke X, Young H S, et al. Polymorphisms in the IL-12beta and IL-23R genes are associated with psoriasis of early onset in a UK cohort. *J Invest Dermatol* 2007; November 22 [Epub ahead of print]
14. Nair R P, Ruether A, Stuart P E, Jenisch S, Tejasvi T, Hiremagalore R, et al. Polymorphisms of the IL12B and IL23R genes are associated with psoriasis. *J Invest Dermatol* 2008; January 24 [Epub ahead of print].
15. Liu Y, Helms C, Liao W, Zaba L C, Duan S, Gardner J, et al. A genome-wide association study of psoriasis and psoriatic arthritis identifies new disease loci. *PLoS Genet.* 2008; 28:e1000041.
16. Duerr R H, Taylor K D, Brant S R, Rioux J D, Silverberg M S, Daly M J, et al. A genome-wide association study identifies IL23R as an inflammatory bowel disease gene. *Science* 2006; 314:1461-1463.
17. Libioulle C, Louis E, Hansoul S, Sandor C, Farnir F, Franchimont D, et al. Novel Crohn disease locus identified by genome-wide association maps to a gene desert on 5p13.1 and modulates expression of PTGER4. *PLoS Genet.* 2007; 3:e58.
18. Wellcome Trust Case Control Consortium. Genome-wide association study of 14,000 cases of seven common diseases and 3,000 shared controls. *Nature* 2007; 447: 661-678.
19. Parkes M, Barrett J C, Prescott N J, Tremelling M, Anderson C A, Fisher S A, et al. Sequence variants in the autophagy gene IRGM and multiple other replicating loci contribute to Crohn's disease susceptibility. *Nat Genet.* 2007; 39:830-832.
20. Raelson J V, Little R D, Ruether A, Fournier H, Paquin B, Van Eerdewegh, et al. Genome-wide association study for Crohn's disease in the Quebec founder population identifies multiple validated disease loci. *Proc Natl Acad Sci USA.* 2007; 104:14747-14752.
21. Tremelling M, Cummings F, Fisher SA, Mansfield J, Gwilliam R, Keniry A, et al. IL23R variation determines susceptibility but not disease phenotype in inflammatory bowel disease. *Gastroenterology* 2007; 132:1657-1664.
22. Van Limbergen J, Russell R K, Nimmo E R, Drummond H E, Smith L, Davies G, et al. IL23R Arg381Gln is associated with childhood onset inflammatory bowel disease in Scotland. *Gut* 2007; 56:1173-1174.
23. Dubinsky M C, Wang D, Picornell Y, Wrobel I, Katzir L, Quiros A, et al. IL-23 receptor (IL-23R) gene protects against pediatric Crohn's disease. *Inflamm Bowel Dis* 2007; 13:511-515.
24. Baldassano R N, Bradfield J P, Monos D S, Kim C E, Glessner J T, Casalunovo T, et al. Association of variants of the interleukin-23 receptor gene with susceptibility to pediatric Crohn's disease. *Clin Gastroenterol Hepatol* 2007; 5:972-976.
25. Wellcome Trust Case Control Consortium, Australo-Anglo-American Spondylitis Consortium (TASC), Burton P R, Clayton D G, Cardon L R, Craddock N, et al. Association scan of 14,500 nonsynonymous SNPs in four diseases identifies autoimmunity variants. *Nat Genet.* 2007; 39:1329-1337.
26. Rueda B, Orozco G, Raya E, Fernandez-Sueiro J L, Mulero J, Blanco F J, et al. The IL23R Arg381R non-synonymous polymorphism confers susceptibility to ankylosing spondylitis. Ann Rheum Dis. 2008; January 16 [Epub ahead of print].
27. Huber A K, Jacobson E M, Jazdzewski K, Concepcion E S, Tomer Y. IL-23R is a major susceptibility gene for Graves' ophthalmopathy: the IL-23/Th17 axis extends to thyroid autoimmunity. *J Clin Endocrinol Metab* 2007; 93:1077-1081.
28. Nunez C, Dema B, Cenit M C, Polanco I, Maluenda C, Arroyo R, et al. IL23R: a susceptibility locus for celiac disease and multiple sclerosis? *Genes Immun.* 2008; March 27 [Epub ahead of print].
29. Illes Z, Safrany E, Peterfalvi A, Magyari L, Farago B, Pozsonyi E, et al. 3'UTR C2370A allele of the IL-23 receptor gene is associated with relapsing-remitting multiple sclerosis. *Neurosci Lett.* 2008; 431:36-38.
30. Roos I M, Kockum I, Hillert J. The interleukin 23 receptor gene in multiple sclerosis: a case-control study. *J Neuroimmunol.* 2008; 194:173-180.
31. Begovich A B, Chang M, Caillier S J, Lew D, Catanese J J, Wang J, et al. The autoimmune disease-associated IL12B and IL23R polymorphisms in multiple sclerosis. *Hum Immunol.* 2007; 68:934-937.
32. Zhang X-J, Yan K-L, Wang Z-M, Yang S, Zhang G-L, Fan X, et al. Polymorphisms in interleukin-15 gene on chromosome 4q31.2 are associated with psoriasis vulgaris in Chinese population. *J Invest Derm* 2007; 127:2544-2551.
33. Chang M, Li Y, Yan C, Duffin K P C, Matsunami N, Garcia V E, et al. Variants in the 5q31 cytokine gene cluster are associated with psoriasis. *Genes Immun* 2007; 9:176-181.
34. Clark A G. The role of haplotypes in candidate gene studies. *Genet Epidemiol* 2004; 27:321-333.
35. International HapMap Consortium. A haplotype map of the human genome. *Nature* 2007; 437:1299-1320.
36. Airoldi I, Di Carlo E, Cocco C, Sorrentino C, Fais F, Cilli M, et al. Lack of il12rb2 signaling predisposes to spontaneous autoimmunity and malignancy. *Blood* 2005; 106: 3846-3853.
37. Lee E, Trepicchio W L, Oestreicher J L, Pittman D, Wang F, Chamian F, et al. Increased expression of interleukin 23 p19 and p40 in lesional skin of patients with psoriasis vulgaris. *J Exp Med* 2004; 199:125-130.
38. Chan J R, Blumenschein W, Murphy E, Diveu C, Wiekowski M, Abbondanzo S, et al. IL-23 stimulates epidermal hyperplasia via TNF and IL-20R2-dependent mechanisms with implications for psoriasis pathogenesis. *J Exp Med* 2006; 203:2577-2587.
39. Ghilardi N, Kljavin N, Chen Q, Lucas S, Gurney A L, de Sauvage F J. Compromised humoral and delayed-type hypersensitivity responses in IL-23-deficient mice. *J Immunol* 2004; 172:2827-2833.
40. Park H, Li Z, Yang XO, Chang S H, Nurieva R, Wang Y H, et al. A distinct lineage of CD4 T cells regulates tissue inflammation by producing interleukin 17. *Nat Immunol* 2005; 6:1133-1141.
41. Harrington L E, Hatton R D, Mangan P R, Turner H, Murphy T L, Murphy K M, et al. Interleukin 17-producing CD4+ effector T cells develop via a lineage distinct from the T helper type 1 and 2 lineages. *Nat Immunol* 2005; 6:1123-1132.
42. Veldhoen M, Hocking R J, Atkins C J, Locksley R M, Stockinger B. TGFβ in the context of an inflammatory cytokine milieu supports de novo differentiation of IL-17-producing T-cells. *Immunity* 2006; 24:179-189.
43. Hue S, Ahern P. Buonocore S, Kullberg M C, Cua D J, McKenzie B S, et al. Interleukin-23 drives innate and T cell-mediated intestinal inflammation. *J Exp Med* 2006; 203:2473-2483.
44. Kauffman C L, Aria N, Toichi E, McCormick T S, Cooper K D, Gottlieb A B, et al. A phase I study evaluating the safety, pharmacokinetics, and clinical response of a human IL-12 p40 antibody in subjects with plaque psoriasis. *J Invest Dermatol* 2004; 123:1037-1044.
45. Krueger G G, Langley R G, Leonardi C, Yeilding N, Guzzo C, Wang Y, et al. A human interleukin-12/23 monoclonal antibody for the treatment of psoriasis. *N Engl J Med* 2007; 356:580-592.
46. Mannon P J, Fuss I J, Mayer L, Elson C O, Sandborn W J, Present D, et al. Anti-interleukin-12 antibody for active Crohn's disease. *N Engl J Med* 2004; 351:2069-2079.
47. Hu X, Schrodi S J, Ross D A, Cargill M. Selecting tagging SNPs for association studies using power calculations from genotype data. *Hum Hered* 2004; 57:156-170.
48. Weir B S. *Genetic Data Analysis II: Methods for Discrete Population Genetic Data.* 1996; Sinauer, Sunderland, Mass., USA.
49. Sokal R R, Rohlf F J. *Biometry* 3$^{rd}$ ed. 1995; W.H. Freeman and Company, USA.
50. Fisher R A. *Statistical Methods for Research Workers,* 12$^{th}$ ed. 1954; Oliver & Boyd, Edinburgh.
51. Mantel N, Haenszel W. Statistical aspects of the analysis of data from retrospective studies of disease. *J Nat Cancer Inst.* 1959; 22:719-748.
52. Excoffier L, Slatkin M. Maximum-likelihood estimation of molecular haplotype frequencies in a diploid population. *Mol Biol Evol* 1995; 12:921-927.
53. Abecasis G R, Cookson W O. GOLD—graphical overview of linkage disequilibrium. *Bioinformatics* 2000; 16:182-183.
54. Schaid D J, Rowland C M, Tines D E, Jacobson R M, Poland G A. Score tests for association between traits and haplotypes when linkage phase is ambiguous. *Am J Hum Genet* 2002; 70:425-434.
55. Yoo J, Seo B, Kim Y. SNPAnalyzer: a web-based integrated workbench for single-nucleotide polymorphism analysis. *Nucleic Acids Res* 2005; 33(Web Server issue): W483-488.
56. Li H. A permutation procedure for the haplotype method for identification of disease-predisposing variants. *Ann Hum Genet* 2001; 65:189-196.

Example 2: Identification and Analysis of Haplotypes and Individual SNPs in the IL12B Region Associated with Psoriasis IL12B Haplotypes Using the same sample sets as described above in Example 1 for the IL23R region, haplotype analyses were carried out to identify SNP haplotypes in the IL12B region that are associated with psoriasis risk.

The sample sets (psoriasis case and control samples) used for the haplotype analyses of the IL12B region are described in Example 1 above ("S0048", "S0056A", and "A0019" as indicated in Tables 9-10 correspond to "Sample Set 1", "Sample Set 2", and "Sample Set 3", respectively, which are described above in Example 1). The sample sets are also the same as those described in U.S. patent application Ser. No. 11/899,017, filed Aug. 31, 2007 (Begovich et al.), and Cargill et al., "A large-scale genetic association study confirms IL12B and leads to the identification of IL23R as psoriasis risk genes", *Am J Hum Genet.* 2007 February; 80(2):273-90, both of which are incorporated herein by reference in their entirety.

Methods were similar to those described above in Example 1, and in U.S. patent application Ser. No. 11/899, 017, filed Aug. 31, 2007 (Begovich et al.), and Cargill et al., "A large-scale genetic association study confirms IL12B and leads to the identification of IL23R as psoriasis risk genes", *Am J Hum Genet.* 2007 February; 80(2):273-90, both of which are incorporated herein by reference in their entirety.

For haplotype analyses, the Haplo.Stats program using an EM algorithm (Schaid et al., "Score tests for association between traits and haplotypes when linkage phase is ambiguous", *Am J Hum Genet* 2002; 70:425-434) and the SNP Analyzer program using a pseudo-Gibbs sampling algorithm (Yoo et al., "SNPAnalyzer: a web-based integrated workbench for single-nucleotide polymorphism analysis", *Nucleic Acids Res* 2005; 33: W483-488) were used.

The results of these analyses are shown in Tables 9 and 10.

As shown in Tables 9 and 10, the following haplotypes were identified in particular as non-risk (protective) haplotypes for psoriasis:

1) rs2546892 (G), rs1433048 (A), rs6894567 (G), rs17860508 (C), rs7709212 (C), rs953861 (A), rs6869411 (T), rs1833754 (T), and rs6861600 (G) (naive odds ratio=0.594); and 2) rs1368437 (C), rs2082412 (A), rs7730390 (C), rs3181225 (G), rs1368439 (T), rs3212227 (G), rs3213120 (C), rs3213119 (G), and rs2853696 (C) (naive odds ratio=0.639).

As shown in Table 10, the following haplotypes were identified in particular as psoriasis risk (susceptibility) haplotypes:

1) rs1368437 (C), rs2082412 (G), rs7730390 (T), rs3181225 (G), rs1368439 (G), rs3212227 (T), rs3213120 (C), rs3213119 (G), and rs2853696 (T) (naive odds ratio=1.241); and 2) rs1368437 (G), rs2082412 (G), rs7730390 (T), rs3181225 (G), rs1368439 (T), rs3212227 (T), rs3213120 (C), rs3213119 (G), and rs2853696 (C) (naive odds ratio=1.346).

Individual IL12B SNPs

In addition to haplotype analysis, analysis of individual SNPs in the IL12B region for association with psoriasis risk was also carried out using the same sample sets (i.e., the sample sets described in Example 1 above and in Cargill et al., "A large-scale genetic association study confirms IL12B and leads to the identification of IL23R as psoriasis risk genes", *Am J Hum Genet.* 2007 February; 80(2):273-90, as well as in patent application Ser. No. 11/899,017, filed Aug. 31, 2007 (Begovich et al.)). In summary, the combined sample sets used in this analysis totaled 1,448 individuals with dermatologist-confirmed psoriasis (cases) and 1,385 "normal" subjects without psoriasis (controls) (these totals included three independent white, North American psoriasis sample sets, as follows: Sample Set 1 (obtained from the University of Utah) consisted of 467 cases and 460 controls, Sample Set 2 (obtained from the Genomics Collaborative Division of SeraCare Life Sciences) consisted of 498 cases and 498 controls, and Sample Set 3 (obtained from Genomics Collaborative and BioCollections Worldwide) consisted of 483 cases and 427 control subjects).

105 SNPs were identified as being associated with psoriasis risk (p-value <0.05), and these SNPs are shown in Table 11. Of these 105 SNPs, the association of 29 of these SNPs with psoriasis was identified by genotyping of the psoriasis sample sets (using the combined total of 1,448 cases and 1,385 controls) and the association of the other 76 SNPs with psoriasis was identified based on imputation. This is indicated in Table 11, in which the column labeled "Genotyped or Imputed" indicates whether the data provided for the given SNP was derived from genotyping of the psoriasis sample sets or by imputation.

Imputation was carried out using the BEAGLE genetic analysis program to analyze genotyping data from the HapMap project (The International HapMap Consortium). Imputation and the BEAGLE program (including the modeling algorithm that BEAGLE utilizes) are described in the following references: Browning, "Missing data imputation and haplotype phase inference for genome-wide association studies", *Hum Genet* (2008) 124:439-450 (which reviews imputation and BEAGLE); B L Browning and S R Browning (2009) "A unified approach to genotype imputation and haplotype phase inference for large data sets of trios and unrelated individuals". *Am J Hum Genet* 84:210-223 (which describes BEAGLE's methods for imputing ungenotyped markers and phasing parent-offspring trios); S R Browning and B L Browning (2007) "Rapid and accurate haplotype phasing and missing data inference for whole genome association studies using localized haplotype clustering". *Am J Hum Genet* 81:1084-1097 (which describes BEAGLE's methods for inferring haplotype phase or sporadic missing data in unrelated individuals); B L Browning and S R Browning (2007) "Efficient multilocus association mapping for whole genome association studies using localized haplotype clustering". *Genet Epidemiol* 31:365-375 (which describes BEAGLE's methods for association testing); S R Browning (2006) "Multilocus association mapping using variable-length Markov chains". *Am J Hum Genet* 78:903-13 (which describes BEAGLE's haplotype frequency model); and B L Browning and S R Browning (2008) "Haplotypic analysis of Wellcome Trust Case Control Consortium data". *Human Genetics* 123:273-280 (which describes an example in which BEAGLE was used to analyze a large genome-wide association study). Each of these references related to imputation and the BEAGLE program is incorporated herein by reference.

Example 3: LD SNPs Associated with Autoinflammatory Diseases

Another investigation was conducted to identify additional SNPs that are calculated to be in linkage disequilibrium (LD) with certain "interrogated SNPs" that have been found to be associated with autoinflammatory diseases, particularly psoriasis, as described herein and shown in the tables. The interrogated SNPs are shown in column 1 (which indicates the hCV identification numbers of each interrogated SNP) and column 2 (which indicates the public rs identification numbers of each interrogated SNP) of Table 4. The methodology is described earlier in the instant application. To summarize briefly, the power threshold (T) was set at an appropriate level, such as 51%, for detecting disease association using LD markers. This power threshold is based on equation (31) above, which incorporates allele frequency data from previous disease association studies, the predicted error rate for not detecting truly disease-associated markers, and a significance level of 0.05. Using this power calculation and the sample size, a threshold level of LD, or $r^2$ value, was derived for each interrogated SNP ($r_T^2$, equations (32) and (33) above). The threshold value $r_T^2$ is the minimum value of linkage disequilibrium between the interrogated SNP and its LD SNPs possible such that the non-interrogated SNP still retains a power greater or equal to T for detecting disease association.

Based on the above methodology, LD SNPs were found for the interrogated SNPs. Several exemplary LD SNPs for the interrogated SNPs are listed in Table 4; each LD SNP is associated with its respective interrogated SNP. Also shown are the public SNP IDs (rs numbers) for the interrogated and LD SNPs, when available, and the threshold $r^2$ value and the power used to determine this, and the $r^2$ value of linkage disequilibrium between the interrogated SNP and its corresponding LD SNP. As an example in Table 4, the interrogated SNP rs10889677 (hCV11283764) was calculated to be in LD with rs2201841 (hCV1272302) at an $r^2$ value of 0.9325, based on a 51% power calculation, thus also establishing the latter SNP as a marker associated with psoriasis (as well as related pathologies such as Crohn's disease).

In general, the threshold $r_T^2$ value can be set such that one of ordinary skill in the art would consider that any two SNPs having an $r^2$ value greater than or equal to the threshold $r_T^2$ value would be in sufficient LD with each other such that either SNP is useful for the same utilities, such as determining an individual's risk for psoriasis (or related pathologies such as Crohn's disease). For example, in various embodiments, the threshold $r_T^2$ value used to classify SNPs as being in sufficient LD with an interrogated SNP (such that these LD SNPs can be used for the same utilities as the interrogated SNP, for example) can be set at, for example, 0.7, 0.75, 0.8, 0.85, 0.9, 0.95, 0.96, 0.97, 0.98, 0.99, 1, etc. (or any other $r^2$ value in-between these values). Threshold $r_T^2$ values may be utilized with or without considering power or other calculations.

All publications and patents cited in this specification are herein incorporated by reference in their entirety. Modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 1

```
Gene Number: 1
Gene Symbol IL12B-3593
Gene Name: interleukin 12B (natural killer cell stimulatory factor 2, cytotoxic 1
ymphocyte maturation factor 2, p40)
Public Transcript Accession: NM_002187
Public Protein Accession: NP_002178
Chromosome: 5
OMIM NUMBER: 161561
OMIM Information: BCG and salmonella infection, disseminated, 209950 (1);
{Asthma, /susceptibility to}, 600807 (3)
Transcript Sequence (SEQ ID NO: 1)
Protein Sequence (SEQ ID NO: 3)
SNP Information Context (SEQ ID NO: 5):
AAGACACAACGGAATAGACCCAAAAAGATAATTTCTATCTGATTTGCTTTAAAACGTTTT
TTTAGGATCACAATGATATCTTTGCTGTATTTGTATAGTTM
GATGCTAAATGCTCATTGAAACAATCAGCTAATTTATGTATAGATTTTCCAGCTCTCAAGT
TGCCATGGGCCTTCATGCTATTTAAATATTTAAGTAATT
Celera SNP ID: hCV2084293
Public SNP ID: rs3212227
SNP Chromosome Position: 158675528
SNP in Transcript Sequence SEQ ID NO: 1
SNP Position Transcript: 1188
SNP Source: dbSNP; Celera; HapMap; HGBASE
Population (Allele, Count): Caucasian (A, 93|C, 27)
SNP Type: UTR3

Context (SEQ ID NO: 6):
CACGGTCATCTGCCGCAAAAATGCCAGCATTAGCGTGCGGGCCCAGGACCGCTACTATAG
CTCATCTTGGAGCGAATGGGCATCTGTGCCCTGCAGTTAGR
TTCTGATCCAGGATGAAAATTTGGAGGAAAAGTGGAAGATATTAAGCAAAATGTTTAAA
GACACAACGGAATAGACCCAAAAAGATAATTTCTATCTGAT
Celera SNP ID: hCV2084294
Public SNP ID: rs3213120
SNP Chromosome Position: 158675686
SNP in Transcript Sequence SEQ ID NO: 1
SNP Position Transcript: 1030
SNP Source: dbSNP; Celera; HapMap; HGBASE;
Population (Allele, Count): Caucasian (G, 117|A, 3)
SNP Type: UTR3

Context (SEQ ID NO: 7):
TGTCTGGAAGGCAAAAAGATCTTAAGATTCAAGAGAGAGGACAAGTAGTTATGGCTAAG
GACATGAAATTGTCAGAATGGCAGGTGGCTTCTTAACAGCCM
TGTGAGAAGCAGACAGATGCAAAGAAAATCTGGAATCCCTTTCTCATTAGCATGAATGAA
CCTGATACACAATTATGACCAGAAAATATGGCTCCATGAA
Celera SNP ID: hCV7537839
Public SNP ID: rs1368439
SNP Chromosome Position: 158674592
SNP in Transcript Sequence SEQ ID NO: 1
SNP Position Transcript: 2124
SNP Source: dbSNP; Celera; HapMap; HGBASE;
Population (Allele, Count): Caucasian (C, 26|A, 94)
SNP Type: UTR3
```

TABLE 1-continued

```
Context (SEQ ID NO: 8):
CCACATTCCTACTTCTCCCTGACATTCTGCGTTCAGGTCCAGGGCAAGAGCAAGAGAGAA
AAGAAAGATAGAGTCTTCACGGACAAGACCTCAGCCACGGK
CATCTGCCGCAAAAATGCCAGCATTAGCGTGCGGGCCCAGGACCGCTACTATAGCTCATC
TTGGAGCGAATGGGCATCTGTGCCCTGCAGTTAGGTTCTG
Celera SNP ID: hCV31985602
Public SNP ID: rs3213119
SNP Chromosome Position: 158676366
SNP in Transcript Sequence SEQ ID NO: 1
SNP Position Transcript: 935
SNP Source: dbSNP; HapMap; HGBASE;
Population (Allele, Count): Caucasian (G, 115|T, 1)
SNP Type: Missense Mutation
Protein Coding: SEQ ID NO: 3, at position 298, (V, GTC) (F, TTC)
Gene Number: 2
Gene Symbol IL23R-149233
Gene Name: interleukin 23 receptor
Public Transcript Accession: NM_144701
Public Protein Accession: NP_653302
Chromosome: 1
OMIM NUMBER: 607562
OMIM Information:
Transcript Sequence (SEQ ID NO: 2)
Protein Sequence (SEQ ID NO: 4)
SNP Information Context (SEQ ID NO: 9):
CTGACAACAGAGGAGACATTGGACTTTTATTGGGAATGATCGTCTTTGCTGTTATGTTGTC
AATTCTTTCTTTGATTGGGATATTTAACAGATCATTCCGR
ACTGGGATTAAAAGAAGGATCTTATTGTTAATACCAAAGTGGCTTTATGAAGATATTCCT
AATATGAAAAACAGCAATGTTGTGAAAATGCTACAGGAAA
Celera SNP ID: hCV1272298
Public SNP ID: rs11209026
SNP Chromosome Position: 67478546
SNP in Transcript Sequence SEQ ID NO: 2
SNP Position Transcript: 1228
SNP Source: dbSNP; Celera; HapMap
Population (Allele, Count): Caucasian (G, 112|A, 8)
SNP Type: Missense Mutation
Protein Coding: SEQ ID NO: 4, at position 381, (R, CGA) (Q, CAA)

Context (SEQ ID NO: 10):
TGCAACAGTCAGAATTCTACTTGGAGCCAAACATTAAGTACGTATTTCAAGTGAGATGTC
AAGAAACAGGCAAAAGGTACTGGCAGCCTTGGAGTTCACTY
TTTTTTCATAAAACACCTGAAACAGTTCCCCAGGTCACATCAAAAGCATTCCAACATGAC
ACATGGAATTCTGGGCTAACAGTTGCTTCCATCTCTACAG
Celera SNP ID: hCV2990018
Public SNP ID: rs7530511
SNP Chromosome Position: 67457975
SNP in Transcript Sequence SEQ ID NO: 2
SNP Position Transcript: 1015
SNP Source: dbSNP; Celera; HapMap
Population (Allele, Count): Caucasian (T, 15|C, 105)
SNP Type: Missense Mutation
Protein Coding: SEQ ID NO: 4, at position 310, (L, CTG) (P, CCG)

Context (SEQ ID NO: 11):
ATCTTGTTTCCAGAGTAGTGACATTTCTGTGCTCCTACCATCACCATGTAAGAATTCCCGG
GAGCTCCATGCCTTTTTAATTTTAGCCATTCTTCTGCCTM
ATTTCTTAAAATTAGAGAATTAAGGTCCCGAAGGTGGAACATGCTTCATGGTCACACATA
CAGGCACAAAAACAGCATTATGTGGACGCCTCATGTATTT
Celera SNP ID: hCV11283764
Public SNP ID: rs10889677
SNP Chromosome Position: 67497708
SNP in Transcript Sequence SEQ ID NO: 2
SNP Position Transcript: 2284
SNP Source: dbSNP; Celera; HapMap
Population (Allele, Count): Caucasian (C, 87|A, 33)
SNP Type: UTR3

Context (SEQ ID NO: 12):
GAGGAGTTGCCATCTATTAATACTTATTTTCCACAAAATATTTTGGAAAGCCACTTCAATA
GGATTTCACTCTTGGAAAAGTAGAGCTGTGTGGTCAAAAK
CAATATGAGAAAGCTGCCTTGCAATCTGAACTTGGGTTTTCCCTGCAATAGAAATTGAAT
TCTGCCTCTTTTTGAAAAAAATGTATTCACATACAAATCT
Celera SNP ID: hCV31222798
Public SNP ID: rs11465827
SNP Chromosome Position: 67497416
SNP in Transcript Sequence SEQ ID NO: 2
```

TABLE 1-continued

SNP Position Transcript: 1992
SNP Source: dbSNP
Population (Allele, Count): Caucasian (T, 117|G, 3)
SNP Type: UTR3

TABLE 2

Gene Number: 1
Gene Symbol: IL12B-3593
Gene Name: interleukin 12B (natural killer cell stimulatory factor 2, cytotoxic 1
ymphocyte maturation factor 2, p40)
Chromosome: 5
OMIM NUMBER: 161561
OMIM Information: BCG and salmonella infection, disseminated, 209950 (1);
{Asthma, /susceptibility
to}, 600807 (3)
Genomic Sequence (SEQ ID NO: 13)
SNP Information Context (SEQ ID NO: 21):
GGAAAGTTTTCGGAGTTTTACAGCAAGAAAAACACCATTATGTTTGATGACATAGGGAG
AAATTTTCTAATGAACCCACAGAATGGACTAAAGGTAAGACR
TACTTTTACTTGTTATGTGCTCATGTAATCTGGGCTGTGTGGTAGAACTTTTGTAGTAAG
CACTGTTGAATTTCATATATTTTTGGAAGTACTGTATTCT
Celera SNP ID: hCV25633374
Public SNP ID: rs12520035
SNP Chromosome Position: 158637948
SNP in Genomic Sequence: SEQ ID NO: 13
SNP Position Genomic: 7814
SNP Source: Applera
Population (Allele, Count): Caucasian (A, 35|G, 5) African American (A, 29|G, 3) total (A, 64|G, 8)
SNP Type: INTRON
SNP Source: dbSNP; HapMap
Population (Allele, Count): Caucasian (A, 112|G, 8)
SNP Type: INTRON Context (SEQ ID NO: 22):
TTGGATCTAAATCACAAATATTGGGAAAGGTAAGTTTTAATTGCTTATTTATTTTCTCTT
TACATCAATGAAGAAAAAATTATCATTTTTCATCAGTGACY
CCAGTATATATATAGCTGTCTTAATTTTTATTTAAAATAGGTGACTTCTAAAAACATTTT
CTAATCCAGTGACCTACCCCCAAAAGTATTTTCCCCTTTC
Celera SNP ID: hCV7537829
Public SNP ID: rs1433046
SNP Chromosome Position: 158642997
SNP in Genomic Sequence: SEQ ID NO: 13
SNP Position Genomic: 12863
SNP Source: Applera
Population (Allele, Count): Caucasian (C, 10|T, 24) African American (C, 17|T, 5) total (C, 27|T, 29)
SNP Type: INTRON; PSEUDOGENE
SNP Source: dbSNP; HapMap; HGBASE
Population (Allele, Count): Caucasian (C, 53|T, 67)
SNP Type: INTRON; PSEUDOGENE Context (SEQ ID NO: 23):
CTGTGTGCCCAGCACTTCCTCTGCATGCCTCAGATGCATTTGACAATCTCAGGTGAACTG
CACTTCAGGGTCAAGGGAACCCCGGCCATGGTTCAAGAAR
CAACTCCCATTTTAGTATCACCTACATTTGAAACCACAGAGCACTGTCCAGGAGAGGTG
ATGGTGGTGGGTCTCCTCCTTTGGCTCTCTGGCCCATCAGC
Celera SNP ID: hCV1992693
Public SNP ID: rs1433048
SNP Chromosome Position: 158688423
SNP in Genomic Sequence: SEQ ID NO: 13
SNP Position Genomic: 58289
SNP Source: dbSNP; Celera; HapMap; ABI_Val; HGBASE
Population (Allele, Count): Caucasian (G, 21|A, 99)
SNP Type: INTRON Context (SEQ ID NO: 24):
ATAAGGGACTGTAGCTCGTCATTTGATGTAGTAGGATATGTAATGATTTAGAAATTTTC
ATGACACATTTAAGTGAAAGAAGTATTTTAGAGAACACTGTY
GTAAGCCGTTAGAAAATAGTTCTTAACCTTTGTTTGGTTCAGGATTACCCTTAATTTAAC
AAAGAACCTGTCAACTCTCTGAGGCTGCTCTTGTTTATAA
Celera SNP ID: hCV2084259
Public SNP ID: rs7708700
SNP Chromosome Position: 158636313
SNP in Genomic Sequence: SEQ ID NO: 13
SNP Position Genomic: 6179

TABLE 2-continued

```
SNP Source: dbSNP; Celera; HapMap; ABI_Val
Population (Allele, Count): Caucasian (T, 26|C, 94)
SNP Type: INTRON Context (SEQ ID NO: 25):
GCCTAGGCTGGTCTCGAGGTCCTGCACTCAAGCGATCCACCTATCTCGGCCTCTCAAAG
TGCAGGATTACAGGCATGAGCCACTGCGCCCAGCCCAGAAAK
AGTTCTAAAATGGAGAAATATCCTCAAATGCTGTGTTTTGTTATCATGCTTTCATAATGC
ACTTGGTAGAAATCTCAAAGATTTCATGTAGATCTTAAAA
Celera SNP ID: hCV2084262
Public SNP ID: rs17665189
SNP Chromosome Position: 158640194
SNP in Genomic Sequence: SEQ ID NO: 13
SNP Position Genomic: 10060
SNP Source: dbSNP; Celera; HapMap
Population (Allele, Count): Caucasian (G, 53|T, 67)
SNP Type: INTRON Context (SEQ ID NO: 26):
ATCATATTATCTAAAATTAATTTAAAATTATTGAAAGACTATCTTGAGTTGTATAAAGAT
ATTTGAGCAGGTGTCTTTTACAAAACAGCAGAATTCTTTAY
TGAAGCTATAAAATAAGGAAAAGTGCATAAATTTATAGTTCAACAAACTGTAAAGATA
ATTCTTGTAAAAAATTTTATTCCACTAAAATTACTCATGATT
Celera SNP ID: hCV2084263
Public SNP ID: rs10515782
SNP Chromosome Position: 158641855
SNP in Genomic Sequence: SEQ ID NO: 13
SNP Position Genomic: 11721
SNP Source: dbSNP; Celera
Population (Allele, Count): Caucasian (C, 26|T, 94)
SNP Type: INTRON; PSEUDOGENE Context (SEQ ID NO: 27):
TAAACTCTTTTTCATCATAAAATAGATCAGCCTTAAACATTTGGAAAATATGGCAGTTCT
TTTTATGGAAAACTCTTGCATAATTAAAAATGATTTTAACR
GAGAATTTAATGATAAAGAAAAATGCTTATGATAAAATGTAGGAGGAAACAGGTTATA
TAAATGTATAATGATATCTCAGCTATATAAAAATTTAATAGA
Celera SNP ID: hCV2084265
Public SNP ID: rs7736656
SNP Chromosome Position: 158642268
SNP in Genomic Sequence: SEQ ID NO: 13
SNP Position Genomic: 12134
SNP Source: dbSNP; Celera; HapMap
Population (Allele, Count): Caucasian (A, 26|G, 94)
SNP Type: INTRON; PSEUDOGENE Context (SEQ ID NO: 28):
TGGAATATAATCCCTCTTCTCATACTGTAACTTAATGTCAGGATAAGATAAAACACATG
TAAAAATTTCATAAATAGTATTAAAAATTACCAGTAACTTGW
GTGTAGCAGAGAAATTAGAAAAGTTTATCCTACTAAAAAAACAATTACTCATAATTTTC
CTTTTTAAAGATAACCACTGTTACCATCTTGGTATATAGTC
Celera SNP ID: hCV2084266
Public SNP ID: rs10042630
SNP Chromosome Position: 158643346
SNP in Genomic Sequence: SEQ ID NO: 13
SNP Position Genomic: 13212
SNP Source: dbSNP; Celera; HapMap
Population (Allele, Count): Caucasian (A, 26|T, 94)
SNP Type: INTRON Context (SEQ ID NO: 29):
CAAAGGCCCCCTTCCATTTCTCCTCTCCAGAGTGTTCCAGTAAGAACATCCCCTTCTAGC
TATTTCACACATGGACAACCAAGAAATAGTCATTTACAGAR
CATTTTGCATTTGTACAATTTCACTCGTTATTTCTCCCCCAGTACCTAATGGGGCTGCA
GCGTGTACTCTGTTCGTGGTTAAATTCTGCTGCCAGAAGT
Celera SNP ID: hCV2084270
Public SNP ID: rs2082412
SNP Chromosome Position: 158650367
SNP in Genomic Sequence: SEQ ID NO: 13
SNP Position Genomic: 20233
SNP Source: dbSNP; Celera; HGBASE
Population (Allele, Count): Caucasian (G, 93|A, 27)
SNP Type: INTERGENIC; UNKNOWN Context (SEQ ID NO: 30):
AGGGGCTACAGGCCCCATGCAATTCTAAAATCCAGCAGAGCAGTCAAATCTTAAAGCT
CCAGAATGATCTCCTTCAACTCCATGTCTCACATTCAGGTCAY
GCTGAAGTAGGTGCCCGAGGTCTTGGGCAGCTCTGCCCCTGTGACTTTGCAAGGTACAG
CCTCTCTCCCGGCTGCCTTCACAATCTGGCATTGAGTGTCT
Celera SNP ID: hCV2084272
```

TABLE 2-continued

Public SNP ID: rs2116821
SNP Chromosome Position: 158657658
SNP in Genomic Sequence: SEQ ID NO: 13
SNP Position Genomic: 27524
SNP Source: dbSNP; Celera; HapMap; HGBASE
Population (Allele, Count): Caucasian (T, 47|C, 67)
SNP Type: INTERGENIC; UNKNOWN Context (SEQ ID NO: 31):
ATAAAAACTAAAGATAACATCTTGACATATGTCCCTGAGTTATTTTTCAGAAACGCAGA
CTCCCACCAGATGGAAAATGTTACATAGGCTGTCACACAGAY
TGAACTCTGACTGCCATTCCTTGTTCTAATTTTCTTCCTGAGGGGCCTGAAGAAAGTCAT
GCACACAGTCCAAACCTGAACATTCCTTTCTGTGGACCCC
Celera SNP ID: hCV2084274
Public SNP ID: rs1433047
SNP Chromosome Position: 158660134
SNP in Genomic Sequence: SEQ ID NO: 13
SNP Position Genomic: 30000
SNP Source: dbSNP; Celera; HapMap; HGBASE
Population (Allele, Count): Caucasian (T, 26|C, 94)
SNP Type: INTERGENIC; UNKNOWN Context (SEQ ID NO: 32):
GAACAGATGACCAGGGGTGACTCAGGACAGAGCAGGTGACCAGGGGAACAGATGTGA
ACTGCTGATTAGAACTGGTGGAAAAAGTTGTTTACTGAAACTAY
GGGCGAGGAGAATGAGGAAGTTAAACTTTAAAATGGAGAACAAAGAACTGAACATACT
GACATACTGATTCTTTGAAGAGAAATTTAGAACTCACTGTAT
Celera SNP ID: hCV2084277
Public SNP ID: rs6874870
SNP Chromosome Position: 158662099
SNP in Genomic Sequence: SEQ ID NO: 13
SNP Position Genomic: 31965
SNP Source: dbSNP; Celera
Population (Allele, Count): Caucasian (T, 23|C, 93)
SNP Type: INTERGENIC; UNKNOWN Context (SEQ ID NO: 33):
CCACTTCCAACATTGGGGATCAAATTTCAACATGAGATTTGGAGGGACAAATATGCAAA
CCATATCAGGTGTTGATGGTGAAGGGGTGCTGTGTTTCTTTY
TGGGGTATTGAAAATATTCCAGAATTTATTGTGGTGATGGGAGCACAACTCTGTAAGTG
TATAAAACCTGTTGAATTAGACACCTTAAAAGAGTCACTTG
Celera SNP ID: hCV2084281
Public SNP ID: rs7730390
SNP Chromosome Position: 158663370
SNP in Genomic Sequence: SEQ ID NO: 13
SNP Position Genomic: 33236
SNP Source: dbSNP; Celera; HapMap
Population (Allele, Count): Caucasian (T, 91|C, 27)
SNP Type: INTERGENIC; UNKNOWN Context (SEQ ID NO: 34):
GTGATAATGTCTGGGCTTGGCAATTACCTTCAGTCTGTTCTCCTCCTGTGATACAGTTAA
TTTTTCCTAATTAATGAGATTCCTGGGGAGGAAACTCATGR
CAATTGAGTGCCTTTTTGGAAGATCTATCTTTAGGCAGACGAGGCAAGTTCAGAGACCA
CCCTTCCCTGTGCTTTTGAAACAGGGGTGAGAGACAGCAGG
Celera SNP ID: hCV2084283
Public SNP ID: rs1549922
SNP Chromosome Position: 158664126
SNP in Genomic Sequence: SEQ ID NO: 13
SNP Position Genomic: 33992
SNP Source: dbSNP; Celera; HapMap; ABI_Val; HGBASE
Population (Allele, Count): Caucasian (G, 63|A, 53)
SNP Type: INTERGENIC; UNKNOWN Context (SEQ ID NO: 35):
ACCAAGGCCAGGTAAAAACCACCCCTTCATCCCCTAAACCTTGCAAGAAGCACAGGGT
CCAGAATTATGCTTCTTTCAGGTTCTAAATAGCACAATAAAAY
TAATAACAATAAGCTTTTAGTTATTAGATCAGGTACATTTTACTTTACAGTAAGCTTTTA
CTTATTGGATCAGGTACATTTTAAAGCAATTTTTGAACAT
Celera SNP ID: hCV2084288
Public SNP ID: rs6870828
SNP Chromosome Position: 158671090
SNP in Genomic Sequence: SEQ ID NO: 13
SNP Position Genomic: 40956
SNP Source: dbSNP; Celera; HapMap
Population (Allele, Count): Caucasian (C, 54|T, 64)
SNP Type: INTRON TABLE 2-continued Context (SEQ ID NO: 36):
AATTACTTAAATATTTAAATAGCATGAAGGCCCATGGCAACTTGAGAGCTGGAAAATCT
ATACATAAATTAGCTGATTGTTTCAATGAGCATTTAGCATCK
AACTATACAAATACAGCAAAGATATCATTGTGATCCTAAAAAAACGTTTTAAAGCAAAT
CAGATAGAAATTATCTTTTTGGGTCTATTCCGTTGTGTCTT
Celera SNP ID: hCV2084293
Public SNP ID: rs3212227
SNP Chromosome Position: 158675528
SNP in Genomic Sequence: SEQ ID NO: 13
SNP Position Genomic: 45394
SNP Source: dbSNP; Celera; HapMap; HGBASE
Population (Allele, Count): Caucasian (T, 93|G, 27)
SNP Type: UTR3; INTRON Context (SEQ ID NO: 37):
ATCAGATAGAAATTATCTTTTTGGGTCTATTCCGTTGTGTCTTTAAACATTTTGCTTAATA
TCTTCCACTTTTCCTCCAAATTTTCATCCTGGATCAGAAY
CTGGAAGAGAATGCCAAAAGTTGATGTGGGGTGACATTGTAACAGCAATGTCTCTTCTT
ATTTCTCACAACATATGATCCTGGGCAACTGGGTTTCAGGG
Celera SNP ID: hCV2084294
Public SNP ID: rs3213120
SNP Chromosome Position: 158675686
SNP in Genomic Sequence: SEQ ID NO: 13
SNP Position Genomic: 45552
SNP Source: dbSNP; Celera; HapMap; HGBASE;
Population (Allele, Count): Caucasian (C, 117|T, 3)
SNP Type: MICRORNA; UTR3; INTRON Context (SEQ ID NO: 38):
GGAAAATGTCTTAGGTTCTCTGTGTCTGTTTCCTCACTTATAAATAGGGATAACAATAAT
GCCTACTTCATAGAATTATAGTTCAAGGTAAAAATCACGTY
AAACTCTTAGCAAGTCTTTAGCACATAGGAAGCACTCAATATCACCTATTAGTCATACA
GATCTTAAATAGGGAAAGTACTTGCCAAGATGTAAAATAAT
Celera SNP ID: hCV2084295
Public SNP ID: rs2195940
SNP Chromosome Position: 158676930
SNP in Genomic Sequence: SEQ ID NO: 13
SNP Position Genomic: 46796
SNP Source: dbSNP; Celera; HapMap; HGBASE
Population (Allele, Count): Caucasian (C, 110|T, 10)
SNP Type: INTRON Context (SEQ ID NO: 39):
GGCTTTGTCCAGTGATTTTAAAAGTGGGGTGAAAGGAGTCTGGGGCGGTACAAAAGGG
CCTCTGGAACCTTGCAACAGGCAAAGGAATTCTGCTGTAAGGY
GAGGAAGCTGGGAAGCCAATATCTTAGCCTCTATAAGTGTAGACATTCTGTTTAGTAAA
ATAATTTTATAATATCTGGAACAGCCAGGAGCTATCCATTT
Celera SNP ID: hCV2084296
Public SNP ID: rs2853696
SNP Chromosome Position: 158677238
SNP in Genomic Sequence: SEQ ID NO: 13
SNP Position Genomic: 47104
SNP Source: dbSNP; Celera; HapMap; ABI_Val; HGBASE
Population (Allele, Count): Caucasian (T, 26|C, 94)
SNP Type: INTRON Context (SEQ ID NO: 40):
CCCCTCTGACTCTCTCTGCAGAGAGTGTAGCAGCTCCGCACGTCACCCCTTGGGGGTCA
GAAGAGCTGAAGTCAAAGACAGAAATTAGCCTGTGTTACACM
TTGGGGAGAGAGTTCCTAGTGATTGTAGCCAGTAAGGCAGGTAAGGCCTCAACTGTTGT
CTGAGGACACAGTTTCTCCAACTGGGCTGATTTCTACCCAG
Celera SNP ID: hCV2084297
Public SNP ID: rs919766
SNP Chromosome Position: 158680142
SNP in Genomic Sequence: SEQ ID NO: 13
SNP Position Genomic: 50008
SNP Source: dbSNP; Celera; HapMap; HGBASE
Population (Allele, Count): Caucasian (A, 110|C, 10)
SNP Type: INTRON Context (SEQ ID NO: 41):
GTCTGCTTCAGGGCCCCTAAGATCTACGCCCTGGAGCTCTTGTTTTTATTTTTGACTCAA
GGTGCAATTTCAGCAAGTCATTTGTAGCTTTGAATTCTCCK
TTTATCCCTTTCTTTGGTGCTATGAGGCTTCAGGAAGCATGGCCAGGCAATTTGGATGAG
TGGGTTCAAACACAGCAGAGACTATTCTCAGTTCCCAATA
Celera SNP ID: hCV2084298
Public SNP ID: rs2853694
SNP Chromosome Position: 158681666
SNP in Genomic Sequence: SEQ ID NO: 13

TABLE 2-continued

```
SNP Position Genomic: 51532
SNP Source: dbSNP; Celera; HapMap; HGBASE
Population (Allele, Count): Caucasian (G, 65|T, 55)
SNP Type: INTRON Context (SEQ ID NO: 42):
TATCTGCCTTACATTTGACTGAGGATTAAATGAAAAAAAAAAAAAGCACGTAAAGTACT
TAGCACAGTGTCTGCCACACAGTAAATTCGGTGTTAGTTATY
GTTACTTATAGACTGAGGAGTCAGCCAACTGTACAGAGAAACTCTCTTAACAATTTTCC
ATGGATATTTAAGGATTTCGTTCCCTCTGTTTTAAATCACC
Celera SNP ID: hCV2084301
Public SNP ID: rs3213093
SNP Chromosome Position: 158683557
SNP in Genomic Sequence: SEQ ID NO: 13
SNP Position Genomic: 53423
SNP Source: dbSNP; Celera; HGBASE
Population (Allele, Count): Caucasian (C, 93|T, 27)
SNP Type: INTRON Context (SEQ ID NO: 43):
TCCCATGATGGTCAAGGAATAATTTTGGAGGAGACGTTTAACTTTAAAAAAAAAAATAC
AATCATTAGTTTCATGTTTGTTTAAAAGAAACTTTGTTTTCS
TAACCAACATTTGAGCTCCATTCATCTCTTGATGCAGGGAGAGATGTTATTGTAAATGTC
TAGTTCTTTATGTTACTTTACAGTAGGGTTTTTAAAAGAC
Celera SNP ID: hCV7537756
Public SNP ID: rs1368437
SNP Chromosome Position: 158639557
SNP in Genomic Sequence: SEQ ID NO: 13
SNP Position Genomic: 9423
SNP Source: dbSNP; Celera; HapMap; ABI_Val; HGBASE
Population (Allele, Count): Caucasian (C, 112|G, 8)
SNP Type: INTRON; PSEUDOGENE Context (SEQ ID NO: 44):
TTCATGGAGCCATATTTTCTGGTCATAATTGTGTATCAGGTTCATTCATGCTAATGAGAA
AGGGATTCCAGATTTTCTTTGCATCTGTCTGCTTCTCACAK
GGCTGTTAAGAAGCCACCTGCCATTCTGACAATTTCATGTCCTTAGCCATAACTACTTGT
CCTCTCTCTTGAATCTTAAGATCTTTTTGCCTTCCAGACA
Celera SNP ID: hCV7537839
Public SNP ID: rs1368439
SNP Chromosome Position: 158674592
SNP in Genomic Sequence: SEQ ID NO: 13
SNP Position Genomic: 44458
SNP Source: dbSNP; Celera; HapMap; HGBASE;
Population (Allele, Count): Caucasian (G, 26|T, 94)
SNP Type: MICRORNA; UTR3; INTRON Context (SEQ ID NO: 45):
GGACAGTAGAGGTGCTTTCCTGTGGGATCCCCAATCTCTCCCCGCCTTCAGGTGAGTCC
TGCTGATGCTCAGGCTGCCCTTGGAACAGGGACCTTGGCCAY
AGTTTCCTTATCTGTAATAATGGGATGAGAATTCCTCCTGCACAGGGTTGTTAGGGACCT
CGTGAGGCAGCTTCTATGGCTGCCTTTGGTGCTTAGTTTT
Celera SNP ID: hCV11316602
Public SNP ID: rs1865014
SNP Chromosome Position: 158671666
SNP in Genomic Sequence: SEQ ID NO: 13
SNP Position Genomic: 41532
SNP Source: dbSNP; HapMap
Population (Allele, Count): Caucasian (T, 20|C, 94)
SNP Type: INTRON Context (SEQ ID NO: 46):
TTAATGGTTATGGGCCATGCATTGAAGGACCACCCTGTCTGTGCTAATCCCTCACTTTGC
ACTGAACATGGAACTAAGCTGAGCCTCTCCCTGGGGATGAR
ATGATAGATTTTCTATTTACTGCCCTTTCTTTTGTCTTTTCATAGCTTTTGGTGCGGACAT
GTCTTGGAGCAGTTACAGTCAATTGTCTCTATGCTCAAT
Celera SNP ID: hCV15803290
Public SNP ID: rs2421047
SNP Chromosome Position: 158678885
SNP in Genomic Sequence: SEQ ID NO: 13
SNP Position Genomic: 48751
SNP Source: dbSNP; Celera; HapMap; HGBASE
Population (Allele, Count): Caucasian (G, 93|A, 27)
SNP Type: TRANSCRIPTION FACTOR BINDING SITE; INTRON Context (SEQ ID NO: 47):
GCTCATTTGCTGTTGAGCAGTGGGAGCAACTTGTTGGCCAAGTTACTCGCTGAGCCTCA
GTCTCTTTGTCTATAAAATGGACCTAATACTTATCTCAAAGR
CTTGTTGGGAAAGGCAATGAGATAACATATTATAGAAGGCAACCAATAACATATTAACT
TGAACCTAGAGGAAGAGGTAAGGGAACAATTCGGTATCTGT
```

TABLE 2-continued

```
Celera SNP ID: hCV15894459
Public SNP ID: rs2546892
SNP Chromosome Position: 158688053
SNP in Genomic Sequence: SEQ ID NO: 13
SNP Position Genomic: 57919
SNP Source: dbSNP; HapMap; HGBASE
Population (Allele, Count): Caucasian (G, 103|A, 17)
SNP Type: INTRON Context (SEQ ID NO: 48):
GAGAAACTTCCAGCACAATTTCAGTTTCATAGAGAATACGGCAGGGCACAATATTCAGC
AGAGTAACATAGTGGTTAAAAGCTCAGGGTGTCGAGAACAAY
GAACCAAGACTGTCATCCTGTCTCCACTAACCAGCTGGGGGATTTGGAACAAGGTATTT
CATTATCATGAGCCTCAGTTTCCTCATCTGTAAAATGATAA
Celera SNP ID: hCV29927086
Public SNP ID: rs3213094
SNP Chromosome Position: 158683347
SNP in Genomic Sequence: SEQ ID NO: 13
SNP Position Genomic: 53213
SNP Source: dbSNP; HapMap; HGBASE
Population (Allele, Count): Caucasian (C, 93|T, 27)
SNP Type: TRANSCRIPTION FACTOR BINDING SITE; INTRON Context (SEQ ID NO: 49):
CTCACCTAACTGCAGGGCACAGATGCCCATTCGCTCCAAGATGAGCTATAGTAGCGGTC
CTGGGCCCGCACGCTAATGCTGGCATTTTTGCGGCAGATGAM
CGTGGCTGAGGTCTTGTCCGTGAAGACTCTATCTTTCTGCAAAAGAGAAGGAAAGCTGT
GAAGACCCCTTGGCAACATAGTCACAGGGTAAGCTGAGCCT
Celera SNP ID: hCV31985602
Public SNP ID: rs3213119
SNP Chromosome Position: 158676366
SNP in Genomic Sequence: SEQ ID NO: 13
SNP Position Genomic: 46232
SNP Source: dbSNP; HapMap; HGBASE;
Population (Allele, Count): Caucasian (C, 115|A, 1)
SNP Type: MISSENSE MUTATION; INTRON Context (SEQ ID NO: 50):
CCTGGGCCCGCACGCTAATGCTGGCATTTTTGCGGCAGATGACCGTGGCTGAGGTCTTG
TCCGTGAAGACTCTATCTTTCTGCAAAAGAGAAGGAAAGCTR
TGAAGACCCCTTGGCAACATAGTCACAGGGTAAGCTGAGCCTGTTTCTGCAATGCATAC
TCTCCCAAAACAAGCCCATCTTGGTCTTAGGGCACTGTGCT
Celera SNP ID: hCV27106395
Public SNP ID: rs11574790
SNP Chromosome Position: 158676424
SNP in Genomic Sequence: SEQ ID NO: 13
SNP Position Genomic: 46290
SNP Source: dbSNP; Celera; HapMap;
Population (Allele, Count): Caucasian (G, 110|A, 10)
SNP Type: INTRON Context (SEQ ID NO: 51):
TAAAAATCTGGTTAGTGTTGTTCATTAAATGTCCGTTAAGTACTTTGGTAACTGCAGATG
AAAGACCCTGTAGGGGACAAACACTTGTTATTAACAACCR
TATGCTGTCAAGTGTGGGCTTATAACACGGGACCATATGCTCCAAAGGTTGGCAAAGAA
TGACAGAAGCCACCCACCATTCCTCCAGGCCAGGAGCAGAG
Celera SNP ID: hCV27467944
Public SNP ID: rs3181224
SNP Chromosome Position: 158673428
SNP in Genomic Sequence: SEQ ID NO: 13
SNP Position Genomic: 43294
SNP Source: dbSNP; HapMap; HGBASE
Population (Allele, Count): Caucasian (A, 110|G, 10)
SNP Type: INTRON Context (SEQ ID NO: 52):
GTAGTGGCTAGATTTACAATAAAAAGGACAGTCCTGGAGACTATCTTTAAAGAAGAAA
AACTCTGCATTGCATGCACTGAAATTAATCGAATGCTAAGAGR
TCATGTCGCAAAAGCACTGGGCATGGTGGGAGCCAGAACATCTCACCTCTGCCCCAGGC
TGGCCAGAAATTTGGGGAAAGGTCCCAGTTCTCAGTGCTTA
Celera SNP ID: hCV27467945
Public SNP ID: rs3181225
SNP Chromosome Position: 158673201
SNP in Genomic Sequence: SEQ ID NO: 13
SNP Position Genomic: 43067
SNP Source: dbSNP; HapMap; HGBASE
Population (Allele, Count): Caucasian (G, 102|A, 18)
SNP Type: INTRON
```

TABLE 2-continued

Context (SEQ ID NO: 53):
GCAATGCTCAACTGTTTCAGTCAAATACCTTAAAAATGAGCATTCCTGGGTTGGGTGAC
GGAATATTGACAAATTACAGCTTTGTCAGAACTGCTACTAAS
TCTAGGCGGACCTTGCTATGTACTTTATTCCCTTATAAAGTTTGTGAGTGGCAGAGACAG
GCCTAGAAGTCAAGCCTTCTTGGACACTGCTCAGTGCTGT
Celera SNP ID: hCV27471935
Public SNP ID: rs3212217
SNP Chromosome Position: 158687708
SNP in Genomic Sequence: SEQ ID NO: 13
SNP Position Genomic: 57574
SNP Source: dbSNP; HapMap; HGBASE
Population (Allele, Count): Caucasian (G, 93|C, 27)
SNP Type: INTRON Context (SEQ ID NO: 54):
TGTGTGCTGGAGCACCCAGAACTGAAGGACTTGGGTTAGGGACAGGAACGGTAATACA
GAGGCGAACTTTCAGGTTCTGGCAACGACCTGGTCACCAGCCM
TTGCTGTAGGGGTTTAGCTTCTCTTGTTTTCCAAGTTCAAAGACTACTCTCTCCCATATA
GAGAACCTAGTGGTTCTAAAATTTGAGTGACTGTCAGGAT
Celera SNP ID: hCV27486507
Public SNP ID: rs3212219
SNP Chromosome Position: 158687039
SNP in Genomic Sequence: SEQ ID NO: 13
SNP Position Genomic: 56905
SNP Source: dbSNP; HGBASE
Population (Allele, Count): Caucasian (C, 89|A, 27)
SNP Type: INTRON Context (SEQ ID NO: 55):
GTTCAAAGACTACTCTCTCCCATATAGAGAACCTAGTGGTTCTAAAATTTGAGTGACTG
TCAGGATAACCTGGAAGCACTGCTACAACAGACGGCTGAGTM
CCACCCCCAGAGTGTCTGATTCAGCAGGCATGAGGGCCTGAGAATATGCATTTCTAGAA
AGTTTCCAGGGGAAGCAGATGCTGCTGGCGCTAAGACCACA
Celera SNP ID: hCV27508808
Public SNP ID: rs3212218
SNP Chromosome Position: 158687174
SNP in Genomic Sequence: SEQ ID NO: 13
SNP Position Genomic: 57040
SNP Source: dbSNP; HapMap; HGBASE
Population (Allele, Count): Caucasian (C, 81|A, 25)
SNP Type: INTRON Context (SEQ ID NO: 56):
AATGAACAGAAAATGGAAGTGAGGTACAGAGACAGCTTGGTTGGTTACAGCTAGGTGT
TTGCTTTATTTGAGCATGGTCTGATCAGTTGGTAACCTATAAY
TGATTGGAGGTTTGCTGCTGTGTTTTACTGCTGAGGCTCAGCTATTAGCTACAAAAATAT
ATTAAATTAGCTTTCAGTCAGTTCATACCAAGTTAGGTTG
Celera SNP ID: hCV28001193
Public SNP ID: rs4921466
SNP Chromosome Position: 158665350
SNP in Genomic Sequence: SEQ ID NO: 13
SNP Position Genomic: 35216
SNP Source: dbSNP; HGBASE
Population (Allele, Count): Caucasian (T, 112|C, 8)
SNP Type: INTERGENIC; UNKNOWN Context (SEQ ID NO: 57):
CTGTATGCCCAGCAAAGGGCTGGTGGCTGGAAGGACATAGCTTTCTGAGTTAGGACTGG
AAGGCTTCTGTACATGTCCAAAGTCAACCTTCATATTCATGR
GGAGGGAAAAAGAAGTGGGCTTTAGGATTGCCTCTCCTTGTTGGCCTGCTCTGAGAAAA
ACAATCGCGGGAGGGTGAGGCGGGAGAATCGCTTGAGCCCA
Celera SNP ID: hCV29349409
Public SNP ID: rs6859018
SNP Chromosome Position: 158669570
SNP in Genomic Sequence: SEQ ID NO: 13
SNP Position Genomic: 39436
SNP Source: dbSNP
Population (Allele, Count): Caucasian (G, 91|A, 27)
SNP Type: INTERGENIC; UNKNOWN Context (SEQ ID NO: 58):
CTCTTATTTTTAAGATGAGAAACTTAAAGCTTAGAGAAGGAATGTGACTTTCTGGATCA
ACATCTAGCAGTTGTTTATTTAGTGCTTACTACATAAAGAGM
ACTGGGCTAGAAGCAGTTGAGAGAGAAAAAAAGGGCTTACCTGGATCCCGCTTCCTAG
GAGCAAATACTTTTACTCAATAAATATTTATTAAGTCAGTGT
Celera SNP ID: hCV30449508
Public SNP ID: rs3212220
SNP Chromosome Position: 158686773
SNP in Genomic Sequence: SEQ ID NO: 13

TABLE 2-continued

SNP Position Genomic: 56639
SNP Source: dbSNP; HapMap; ABI_Val; HGBASE
Population (Allele, Count): Caucasian (C, 93|A, 27)
SNP Type: INTRON Context (SEQ ID NO: 59):
GGATTACACAAATGTGTGAACAGCAGAAGGTAGAAACATTGAGGGTTATGGTACAGTC
TGTTTGCCACAATCCCTGAATCCATTCTTTAAAAAGTTGGTAK
AAAAATACCTACTTTAGAGGGTTGTTATGTGAATTCAAAACAAGATAACATATATCGAG
TGTTTACGTGGTACCTGGCACATAGTGAGCATTCAATAAAT
Celera SNP ID: hCV30557642
Public SNP ID: rs10056599
SNP Chromosome Position: 158655488
SNP in Genomic Sequence: SEQ ID NO: 13
SNP Position Genomic: 25354
SNP Source: dbSNP; HapMap; ABI_Val
Population (Allele, Count): Caucasian (T, 93|G, 27)
SNP Type: INTERGENIC; UNKNOWN Context (SEQ ID NO: 60):
TACTACAGGGGAGAACACTGGTGGACAGACACAACCTAAACAAAGTGATCAAAGTTAA
TTTCACCAGTACTGAGAGACATTGATTTCATGCCCCTCCTGAY
GAGATTCACTGAGAAGGGCACAGTATTACTGCTGTAGGATGCTTGACAAAAATGTAGA
ACCCAAATTTAATCATGAAGAAACATGAGACAAATGTCACTT
Celera SNP ID: hCV29619986
Public SNP ID: rs10072923
SNP Chromosome Position: 158668354
SNP in Genomic Sequence: SEQ ID NO: 13
SNP Position Genomic: 38220
SNP Source: dbSNP; HapMap
Population (Allele, Count): Caucasian (T, 93|C, 27)
SNP Type: INTERGENIC; UNKNOWN Context (SEQ ID NO: 61):
CCGATAGTGCCCACGGTGAACCCGTATTATTGTTCCTCTATCAGGTAGCTCAATATATAT
GAAAAGATAGTGGAATCTGCTAGGTGATACAGGTGAGGGAR
GATCCTTTGATTTGAGTTGATGACAGGAATTCAGCTGAGTCATGTTTTAGGATGCAGGC
TCATACCTAGAACCATCTTGAAAGTACCATCTGGGAGCAAG
Celera SNP ID: hCV31985608
Public SNP ID: rs12652431
SNP Chromosome Position: 158654672
SNP in Genomic Sequence: SEQ ID NO: 13
SNP Position Genomic: 24538
SNP Source: dbSNP; HapMap
Population (Allele, Count): Caucasian (A, 94|G, 10)
SNP Type: INTERGENIC; UNKNOWN Context (SEQ ID NO: 62):
GACTTTTCAGGAATCTAGAGGTAAATCAATTATTTAATTGAATACAAATCCCTCTTACTT
TTATTCCCAGTTCTTAATTCTCTGGAGCACTGATTGCTATY
ACTTCTTGTTGGATAATCTGTGAGGAGAACTGCTGTAGCTTCCTAAATAAGGCTTTTGAA
AGAGCCAGTGGTTTGTCAGAAAAACATGTGACTAAAATCC
Celera SNP ID: hCV30629526
Public SNP ID: rs4921458
SNP Chromosome Position: 158648241
SNP in Genomic Sequence: SEQ ID NO: 13
SNP Position Genomic: 18107
SNP Source: dbSNP; HapMap; ABI_Val; HGBASE
Population (Allele, Count): Caucasian (T, 26|C, 94)
SNP Type: INTERGENIC; UNKNOWN Context (SEQ ID NO: 63):
ATAGCTTTTCATTTTTTAACTGGGGCCAAAGTTAGTTAATCCACAAGAATGGGGATCCC
AGCTGTCATTTTGGTTGATATCACAACTGACGACCAAGACCR
TCACAAATATGGGAGCAAGTCTGATTTGTAACATTATTATAATTATGAATCCAATTACTT
TAAGGAATGCACGAAAGGCTTTTTAAAAATTTCAATAGTA
Celera SNP ID: hDV71045748
Public SNP ID: rs6894567
SNP Chromosome Position: 158689546
SNP in Genomic Sequence: SEQ ID NO: 13
SNP Position Genomic: 59412
SNP Source: dbSNP; HapMap
Population (Allele, Count): Caucasian (A, 94|G, 26)
SNP Type: INTRON Context (SEQ ID NO: 64):
ACAGACCTAGTTAGACCATAGTCCATATTTCAAATATAATTACATGTGCTCATAGCTGA
GAACCTTCTCCTGGGATGGATGCATTTCACCAGGTCACTGCY
GAAATGTTGTACTTTTATGGATGGTGATGAGGAAGCATCTGTTTTAGGTGTGGTATTTCC
TGGAGGCAGAAAACTGCTTGAGTTAGCTCATTCAGTTTTT TABLE 2-continued

```
Celera SNP ID: hCV31985592
Public SNP ID: rs7709212
SNP Chromosome Position: 158696755
SNP in Genomic Sequence: SEQ ID NO: 13
SNP Position Genomic: 66621
SNP Source: dbSNP; HapMap; ABI_Val
Population (Allele, Count): Caucasian (T, 76|C, 44)
SNP Type: INTRON Context (SEQ ID NO: 65):
AAAACATATGGGTTGGGTTATCCACTTCAATGACTGCACATTAAGCAAGAGTATAGTGT
ACCATGTTTTATTTAACCATTCCTCTGCTGATTATGTCTTTW
TGCACTTGGAGAAACATTTCTTTAGTAAGCATTTTCCTTTTAAAGATGAAAAAGTGAGA
CCCCAATGCTTAATTTACTCAGTGAAATAATGGTAAAGTCA
Celera SNP ID: hDV75439995
Public SNP ID: rs3213097
SNP Chromosome Position: 158681257
SNP in Genomic Sequence: SEQ ID NO: 13
SNP Position Genomic: 51123
SNP Source: CDX; dbSNP
Population (Allele, Count): Caucasian (T, 89|A, 27)
SNP Type: INTRON Context (SEQ ID NO: 66):
GTGATTCAGATCTGGGATGGGGCTCAGGAACCTGCATTTTAACAATGGAGGTTCTAATG
TGGTCATTGGCAGGTTGTTCTAATGTGGGGGCCACATTAGAG
/TTAGA
CCTCTCTCGGAGACAGGCTGTACATGGCCAGCCAGCATTCTGGTAATATGAGCCAAATG
CCCATTGACCTAATTTTGGAGAAGAGGTTTATCAACATGTC
Celera SNP ID: hDV79877074
Public SNP ID: rs17860508
SNP Chromosome Position: 158692783
SNP in Genomic Sequence: SEQ ID NO: 13
SNP Position Genomic: 62649
SNP Source: dbSNP
Population (Allele, Count): no_pop (G, -|, -)
SNP Type: INTRONIC INDEL Context (SEQ ID NO: 67):
GTTTACAATGAGGATATTTTAGGGAAAGAATACTAATCTAGGTAGTGAATTGCCATAAG
TATAAAAACTGTTGACTTGGAAGAAAAGTGGTTATGTTGTCY
TTAATGGTTTCTGTTTAAGGCTTGGAGAGAAGTGCTTTTCTTAATATGTACTGCACCAGG
TAAAGGTACAAAAATGTATTCTTGAGTCTTGAGAAGAAAT
Celera SNP ID: hCV2084260
Public SNP ID: rs13153734
SNP Chromosome Position: 158639291
SNP in Genomic Sequence: SEQ ID NO: 13
SNP Position Genomic: 9157
Related Interrogated SNP: hCV27467945 (Power = .51)
SNP Source: dbSNP; Celera
Population (Allele, Count): Caucasian (C, 98|T, 20)
SNP Type: INTRON; PSEUDOGENE Context (SEQ ID NO: 68):
CGAAATCAGTTATTGGACTAATGATACCTATAGCAGCTCTTCAGTGTAAAAGGTAAGGA
ATGGAAAAACAGGTTGTTACAGTAAGCAACTGAAACTTATTY
TTTATTCATGGAAAGTAAAATAGTTCCTTGAGAGGAAGAGGAACTACAGGATAGGGAC
TGGGAAAAAAGGATATGCAAAAAAACGCAGATTAGTTGCATT
Celera SNP ID: hCV2084269
Public SNP ID: rs6895626
SNP Chromosome Position: 158646681
SNP in Genomic Sequence: SEQ ID NO: 13
SNP Position Genomic: 16547
SNP Source: dbSNP; Celera; HapMap
Population (Allele, Count): Caucasian (T, 26|C, 94)
SNP Type: INTERGENIC; UNKNOWN Context (SEQ ID NO: 69):
CCATATCAGGTGTTGATGGTGAAGGGGTGCTGTGTTTCTTTTTGGGGTATTGAAAATATT
CCAGAATTTATTGTGGTGATGGGAGCACAACTCTGTAAGTS
TATAAAACCTGTTGAATTAGACACCTTAAAAGAGTCACTTGTAGAGTATGTGAACTATA
CCTCATTACAGCTGTTAGAAAAATGTATACCTTGGTGGTCA
Celera SNP ID: hCV2084282
Public SNP ID: rs2099327
SNP Chromosome Position: 158663429
SNP in Genomic Sequence: SEQ ID NO: 13
SNP Position Genomic: 33295
Related Interrogated SNP: hCV27467945 (Power = .51)
```

TABLE 2-continued

```
SNP Source: dbSNP; Celera; HGBASE
Population (Allele, Count): Caucasian (G, 100|C, 20)
SNP Type: INTERGENIC; UNKNOWN Context (SEQ ID NO: 70):
AATATCTGATTGTGTTACTTCCTTGCTGAAAACCCTTCAGTGGGTTTCAGGGCCCGGGGC
CCCCAGAACAAGATTCTGAGTCCTGCAAGCTTGCAAGTCCK
CCATGCTCTGCCTCCTGGCTACCTCTCTCTTTTCTTTGCCTTTTCTCTTTAGGAGGCCAGAA
CCCCGGTCTGTTTTCTTTCCTGCAATATCCCTGTGGCCA
Celera SNP ID: hCV15824051
Public SNP ID: rs2853697
SNP Chromosome Position: 158675981
SNP in Genomic Sequence: SEQ ID NO: 13
SNP Position Genomic: 45847
Related Interrogated SNP: hCV15894459 (Power = .51)
Related Interrogated SNP: hCV27467945 (Power = .51)
SNP Source: dbSNP; HapMap; HGBASE
Population (Allele, Count): Caucasian (T, 102|G, 18)
SNP Type: TRANSCRIPTION FACTOR BINDING SITE; INTRON Context (SEQ ID NO: 71):
TGGAGGTTAACATCAATTAACATCAATAAGAGACTTGATGTTAATTCATTACACTCACC
ATGACTTGGCTTTTCAATTTGTTGTTGTTGTTGTTTTTAACY
CTTATGAGCGAAAGAGAAAATTGATACTATCCAAGGGTATAGAATTACCTTTCTGGTCC
TTTAAAATATCAGTGGACCAAATTCCATCTTCCTTTTTGTG
Celera SNP ID: hCV15879826
Public SNP ID: rs2288831
SNP Chromosome Position: 158682591
SNP in Genomic Sequence: SEQ ID NO: 13
SNP Position Genomic: 52457
Related Interrogated SNP: hCV2084270 (Power = .51)
Related Interrogated SNP: hCV2084293 (Power = .51)
Related Interrogated SNP: hDV71045748 (Power = .51)
SNP Source: dbSNP; HapMap; ABI_Val; HGBASE
Population (Allele, Count): Caucasian (T, 91|C, 25)
SNP Type: TRANSCRIPTION FACTOR BINDING SITE; INTRON Context (SEQ ID NO: 72):
TGAAGCAGTCCAGTAGAGCTTAGTCTTCCCATTTAATGAAGAAGCGTACTGAGGCCAAC
GATCTAAGCATGGTCACAGCAAGTCAGAAGTACAAGGGCTAY
AGCTCAGACCTTTTGTCTCTTGGGCTTTGCAAGGGATGCCTAATGCTAGTGTCTAAACTG
GCCTTTGAGGAATGGCTTAGTATAGTATTTCAGAGTGTGT
Celera SNP ID: hCV16044033
Public SNP ID: rs2569254
SNP Chromosome Position: 158683827
SNP in Genomic Sequence: SEQ ID NO: 13
SNP Position Genomic: 53693
Related Interrogated SNP: hCV27467945 (Power = .51)
SNP Source: dbSNP; HapMap; HGBASE
Population (Allele, Count): Caucasian (C, 102|T, 18)
SNP Type: INTRON Context (SEQ ID NO: 73):
TCACAAGTCTGTTATGTAACCATAGTTGGGACTGGAGTCTGCTCCTCTGATTCCCAGTCC
TAAGATCTTTGGCTTAGACATTTAGTACATTTTGTAGTGGS
TAGATTTACAATAAAAAGGACAGTCCTGGAGACTATCTTTAAAGAAGAAAAACTCTGC
ATTGCATGCACTGAAATTAATCGAATGCTAAGAGGTCATGTC
Celera SNP ID: hCV27467946
Public SNP ID: rs3181226
SNP Chromosome Position: 158673108
SNP in Genomic Sequence: SEQ ID NO: 13
SNP Position Genomic: 42974
Related Interrogated SNP: hCV15894459 (Power = .51)
Related Interrogated SNP: hCV27467945 (Power = .51)
SNP Source: dbSNP; HapMap; ABI_Val; HGBASE
Population (Allele, Count): Caucasian (G, 102|C, 18)
SNP Type: INTRON Context (SEQ ID NO: 74):
TTATGTCTTTATGCACTTGGAGAAACATTTCTTTAGTAAGCATTTTCCTTTTAAAGATGA
AAAAGTGAGACCCCAATGCTTAATTTACTCAGTGAAATAAW
GGTAAAGTCAGGATGATCACCTGGGGTTTGCTTCGGTGATGATTAAAGTAAGCCACATG
GGGGTTAACACATAGGTCTTGTATTTATGGAAGTTGCTTTC
Celera SNP ID: hCV32389155
Public SNP ID:
SNP Chromosome Position: 158681347
SNP in Genomic Sequence: SEQ ID NO: 13
```

TABLE 2-continued

SNP Position Genomic: 51213
SNP Source: HGBASE; dbSNP
Population (Allele, Count): no_pop (A, —|T, —)
SNP Type: INTRON Context (SEQ ID NO: 75):
TCTGGCGAATTCTACGTGAAATGTCAGGAACCAGTGAAGGGTGTTAAGCATAGAATGA
CAATCTAATTTTTTTTAACAGCCTTATTGAGATAGAATTTACM
TATCACAAATTTACCCATTTGAAGTGTGCAGTTCAATGGTTTTTAGTGTATTTAGAGAGC
TGTACAACCATCACTGTAAGCTAATTTTAGAACCTGATTT
Celera SNP ID: hCV31985611
Public SNP ID: rs13161132
SNP Chromosome Position: 158649646
SNP in Genomic Sequence: SEQ ID NO: 13
SNP Position Genomic: 19512
Related Interrogated SNP: hCV27467945 (Power = .51)
SNP Source: dbSNP; HapMap
Population (Allele, Count): Caucasian (A, 88|C, 16)
SNP Type: INTERGENIC; UNKNOWN
Gene Number: 2
Gene Symbol: IL23R-149233
Gene Name: interleukin 23 receptor
Chromosome: 1
OMIM NUMBER: 607562
OMIM Information:
Genomic Sequence (SEQ ID NO: 14)
SNP Information Context (SEQ ID NO: 76):
TCTGGCAAAGAGAAGGCCACACACCAGGAAGCCCCTGAGGGTACAGGGACATTACTGA
TTATAAAGGAGGGAAGGAACAAGCTATGTGTGTTCCTGATAAM
CCCTGGCCCTCGGGATTGGCTGTCAAGGGGCTCAAAACCCAGTCCAAGGGACAAACAC
ATCATCCAAGCCTTGCAATGCAGTGATGTAAGTGCAATGATA
Celera SNP ID: hCV261080
Public SNP ID: rs10889675
SNP Chromosome Position: 67494804
SNP in Genomic Sequence: SEQ ID NO: 14
SNP Position Genomic: 100047
SNP Source: dbSNP; Celera; HapMap; ABI_Val
Population (Allele, Count): Caucasian (C, 105|A, 15)
SNP Type: INTRON Context (SEQ ID NO: 77):
TTAGACAACAGAGGAGACATTGGACTTTTATTGGGAATGATCGTCTTTGCTGTTATGTTG
TCAATTCTTTCTTTGATTGGGATATTTAACAGATCATTCCR
AACTGGGTAGGTTTTTGCAGAATTTCTGTTTTCTGATTTAGACTACATGTATATGTATCA
CCAAAATTTAGTCATTTCAGTTGTTTACTAGAAAAATCTG
Celera SNP ID: hCV1272298
Public SNP ID: rs11209026
SNP Chromosome Position: 67478546
SNP in Genomic Sequence: SEQ ID NO: 14
SNP Position Genomic: 83789
SNP Source: dbSNP; Celera; HapMap
Population (Allele, Count): Caucasian (G, 112|A, 8)
SNP Type: MISSENSE MUTATION; ESE; INTRON Context (SEQ ID NO: 78):
AACTCCTGGACTCAAGAACTCTGCCCACCTTGGCCTCCCAAAGTGCTGGGCTTACAGGC
AGGAGCCACCATGCCTGGCCTATGATTATGCTTTTTCTTGAR
GTCATCATCTTCTATATTAGTTTCCTATTACTACTGTCACAAATCATCACAAACTTGAAA
GCTTAAAACAACATGAATTTATTATCTTATAGTTCTGGAG
Celera SNP ID: hCV1272302
Public SNP ID: rs2201841
SNP Chromosome Position: 67466790
SNP in Genomic Sequence: SEQ ID NO: 14
SNP Position Genomic: 72033
SNP Source: dbSNP; Celera; HapMap; HGBASE
Population (Allele, Count): Caucasian (A, 87|G, 33)
SNP Type: INTRON Context (SEQ ID NO: 79):
GACTAGAAATTGAGGCTATACCTGCAATGGGAGCAATGTACCTGCCTTTGTCCCAACTC
AGGGGAAAAATTCAAGCTGCTTTATCACAATGCAAACTTCGY
GGGGGAGAAAGGGTTTCTTTCTATAATTCTTGTATTCAAGAAGGATTCATTGAACTACT
GAATGTCCTTACTGTTATATGTGCAAGGCCATTTGAAGGAT
Celera SNP ID: hCV2720250
Public SNP ID: rs4655531
SNP Chromosome Position: 67500366
SNP in Genomic Sequence: SEQ ID NO: 14
SNP Position Genomic: 105609

TABLE 2-continued

SNP Source: Celera; HGBASE; dbSNP
Population (Allele, Count): no_pop (C, -|T, -)
SNP Type: INTERGENIC; UNKNOWN Context (SEQ ID NO: 80):
AATTGAACCCAGGCCACCACTGTGAAAGTAAAAAACTTTAGCTACTGAGCTACAGTACT
GGGTAGTCTCCATTGTGCTTCCCAGAAGGGCTCTAAAGTACK
TAATTTTGAGCTTGCAAAAGCTTTTAACTACTCAACTTAATTTTTAGAGCTAACTGTGAC
ATGAACCCTAAAATTCCTGTTCCCTTGAAGGCAGAGACCA
Celera SNP ID: hCV2720255
Public SNP ID: rs10889674
SNP Chromosome Position: 67490116
SNP in Genomic Sequence: SEQ ID NO: 14
SNP Position Genomic: 95359
SNP Source: dbSNP; Celera
Population (Allele, Count): Caucasian (G, 43|T, 77)
SNP Type: INTRON Context (SEQ ID NO: 81):
TATTATTATCTCTATTTTCCAAAAGAGAAAACCTGAGACTCAGCAAGTTCATAATTATGC
CCCAAGGTCACAGAGCTGATAAGAGGCAGAGTTTAATTCAM
ACCCAGGTATATCAGGCCACGCTCTTGGTCATTCTGCTCTACTGCTTAGACCCCTTTGCC
GAGCACTGTGTTGACCTGAGGGCTGTCTATCCTCTTCCAG
Celera SNP ID: hCV2989999
Public SNP ID: rs1343152
SNP Chromosome Position: 67476920
SNP in Genomic Sequence: SEQ ID NO: 14
SNP Position Genomic: 82163
SNP Source: dbSNP; Celera; HapMap; HGBASE
Population (Allele, Count): Caucasian (A, 74|C, 42)
SNP Type: INTRON Context (SEQ ID NO: 82):
GTGCAACAGTCAGAATTCTACTTGGAGCCAAACATTAAGTACGTATTTCAAGTGAGATG
TCAAGAAACAGGCAAAAGGTACTGGCAGCCTTGGAGTTCACY
GTTTTTTCATAAAACACCTGAAACAGGTGAGTGTACTTATATATTTTATTCTGTTGGGCT
TTTCTTTATATATCTTTTCTGCTGAGCACAGTGGCTCACA
Celera SNP ID: hCV2990018
Public SNP ID: rs7530511
SNP Chromosome Position: 67457975
SNP in Genomic Sequence: SEQ ID NO: 14
SNP Position Genomic: 63218
SNP Source: dbSNP; Celera; HapMap
Population (Allele, Count): Caucasian (T, 15|C, 105)
SNP Type: MISSENSE MUTATION; ESS; UTR5

Context (SEQ ID NO: 83):
GTGCAATCTCGGCTCACTGCAACCTCCATCTCCTGGGTTCAAGTGATTCTCATGCCTCAG
CCTCCCAAGTAGCTAGGAATACAGGCACACACCACCATTTS
CAACTAATTTTTATATTTTTGGTGGAGACGGGATTTCACCATGTTGGCCAGGCTGCTCTT
GAGCTCTTGGCCTCAAGTGATCTGCCTGTCTTTGCCTCCC
Celera SNP ID: hCV8367042
Public SNP ID: rs1008193
SNP Chromosome Position: 67492499
SNP in Genomic Sequence: SEQ ID NO: 14
SNP Position Genomic: 97742
SNP Source: dbSNP; Celera; HapMap; HGBASE
Population (Allele, Count): Caucasian (G, 82|C, 38)
SNP Type: INTRON Context (SEQ ID NO: 84):
TTGAGTATTTCTAAGCTGCTCGATAGATTAGAGTTGTTTGGTGTGGCAGTTCCCCAGTGT
GTCCAGTTGCTCACAAATTTTGACTTGAATGTTCTTTGCCR
AATTGGCACTGAGTTTCTCCTTCTTGCCATCATTTGCTTCATGAAATAATCTTTCTTTCGT
TTACATTTATAATCAAGTGCAGTAGAAAGATTTTAAATG
Celera SNP ID: hCV8367043
Public SNP ID: rs1343151
SNP Chromosome Position: 67491717
SNP in Genomic Sequence: SEQ ID NO: 14
SNP Position Genomic: 96960
SNP Source: dbSNP; Celera; HapMap; ABI_Val; HGBASE
Population (Allele, Count): Caucasian (G, 73|A, 47)
SNP Type: TRANSCRIPTION FACTOR BINDING SITE; INTRON Context (SEQ ID NO: 85):
GCAAGACCCTGTCTCAGGAAAAAAAAAAAAAAGAGGAAAAAGAAGAAAAAGAAAAAG
AAACATGAAGAAAGGTAAGGGCACTCTGAATTATCAATCAATTR
CAAGCCAAGTGCTTAGGTTCAGTACAGTTCCCTAATTATAGATGCCTACACAGACCTAC
CTACACCTTGATATTTCTGTGGGATCAGTGGAGGTTAGGAA
Celera SNP ID: hCV11283754

TABLE 2-continued

```
Public SNP ID: rs10489628
SNP Chromosome Position: 67476695
SNP in Genomic Sequence: SEQ ID NO: 14
SNP Position Genomic: 81938
SNP Source: dbSNP; Celera; HapMap; ABI_Val
Population (Allele, Count): Caucasian (G, 66|A, 54)
SNP Type: INTRON Context (SEQ ID NO: 86):
ATCTTGTTTCCAGAGTAGTGACATTTCTGTGCTCCTACCATCACCATGTAAGAATTCCCG
GGAGCTCCATGCCTTTTTAATTTTAGCCATTCTTCTGCCTM
ATTTCTTAAAATTAGAGAATTAAGGTCCCGAAGGTGGAACATGCTTCATGGTCACACAT
ACAGGCACAAAAACAGCATTATGTGGACGCCTCATGTATTT
Celera SNP ID: hCV11283764
Public SNP ID: rs10889677
SNP Chromosome Position: 67497708
SNP in Genomic Sequence: SEQ ID NO: 14
SNP Position Genomic: 102951
SNP Source: dbSNP; Celera; HapMap
Population (Allele, Count): Caucasian (C, 87|A, 33)
SNP Type: UTR3

Context (SEQ ID NO: 87):
AAAATCCATTGCTGTAGAGGTCAGACACACTCTTTAAGAGAAGGAAGTGTCATCATAAA
AGACAACATAGGGAATGGACAGAAAATGTGGACAGAAAGGCR
GAGTGGATATGATTGCCCAAGCCATTGAAACGGGAGAGTTCCCTGACTCCTGTCGCATA
TCATGTGGCTCATCTATTCTGCCAAGGCACATGCTCAAACC
Celera SNP ID: hCV27952715
Public SNP ID: rs4655692
SNP Chromosome Position: 67464253
SNP in Genomic Sequence: SEQ ID NO: 14
SNP Position Genomic: 69496
SNP Source: dbSNP; HapMap; HGBASE
Population (Allele, Count): Caucasian (A, 25|G, 93)
SNP Type: INTRON Context (SEQ ID NO: 88):
CAGCCTAAATTTTAGGGCTTTATTATATAACATTCTCTTTTTAAATATGCGGTAGTTACG
GTCACCTTGGAAAGTTCTACAAAATATCCCTTAAGTTTTTY
GAACTTTCCCACATGGGAATCTTCTGGTTATGAGAGTTTGCTCTATTTAATATGTGTACG
GTTTCACTGCTAGGGTGGTTCTCCCACTTATCTTGAATCT
Celera SNP ID: hCV30243123
Public SNP ID: rs6693831
SNP Chromosome Position: 67493455
SNP in Genomic Sequence: SEQ ID NO: 14
SNP Position Genomic: 98698
SNP Source: dbSNP; HapMap
Population (Allele, Count): Caucasian (T, 30|C, 90)
SNP Type: INTRON Context (SEQ ID NO: 89):
ACTCTATAACTGCCTAGCAAGATTATGCAAATTGATAACTACCATTTATCATTTACGAA
GTACTCCTGTGTATAAGCTTGTTTGATTATGATGTCAGCCAY
ATTTGGTAGTGTAATTAGCGCTACTTTACAAAAGCGGAAACTGGGCATGACTTACTAAA
TAGTACATTGCTGGTGGGTAATGACACCTAAACTATAACAA
Celera SNP ID: hCV30279129
Public SNP ID: rs10489629
SNP Chromosome Position: 67460937
SNP in Genomic Sequence: SEQ ID NO: 14
SNP Position Genomic: 66180
SNP Source: dbSNP; HapMap
Population (Allele, Count): Caucasian (T, 58|C, 62)
SNP Type: INTRON Context (SEQ ID NO: 90):
AATCAGTATGATTGTAACCAGCTTTAGACATTGTTACAGCAATTGGGAATTCTCACCTGT
GTCAGACAAGCCAAATGAAGCTCACCACTAAGAATTTATAY
GAAATTTGCATGCACAAGCCGACCACATTTGCCAGAGATGCACTTCTAAAAACCCACTG
ACATCAGATACATGTAGCCCAACTTTCTCAAACAAAAAGTT
Celera SNP ID: hCV31222826
Public SNP ID: rs10789229
SNP Chromosome Position: 67478162
SNP in Genomic Sequence: SEQ ID NO: 14
SNP Position Genomic: 83405
SNP Source: dbSNP; HapMap
Population (Allele, Count): Caucasian (C, 50|T, 62)
SNP Type: TRANSCRIPTION FACTOR BINDING SITE; INTRON
```

TABLE 2-continued

Context (SEQ ID NO: 91):
ACCCACTGACATCAGATACATGTAGCCCAACTTTCTCAAACAAAAAGTTGTTTCCTGGG
GTAGTTGTGCACTCTGGAAAAACAGTCACTCTGTGGCCTAAR
GTAAAGGTTAATTTTGCTTCCCCCCACCCTTTCTCCTTTGAGACCTTTGCTTTGAGCAGA
GTAAAGAGAATAGTAATTCTGGTATCAAATGAAGACTAAT
Celera SNP ID: hCV31222825
Public SNP ID: rs10889671
SNP Chromosome Position: 67478314
SNP in Genomic Sequence: SEQ ID NO: 14
SNP Position Genomic: 83557
SNP Source: dbSNP; HapMap
Population (Allele, Count): Caucasian (A, 14|G, 106)
SNP Type: INTRON Context (SEQ ID NO: 92):
GGTTGAAGTATGGTCCACTGGGATTGGCCAAGACTCAGTTACTGTTACAGGCACATACT
CCTAAGTCAGGTTTTCACTCTTGTCTGCCTGTTAAGTTAGGW
TACAGTTCATCCACAGGGATTCAAATATAGAGGTATGAAGTCCTTCTCAGGCCATATTT
AGTTTGCTTTAACACTTGAATTCCACCCAAACAAATCAGCT
Celera SNP ID: hCV31222811
Public SNP ID: rs12085634
SNP Chromosome Position: 67491301
SNP in Genomic Sequence: SEQ ID NO: 14
SNP Position Genomic: 96544
SNP Source: dbSNP
Population (Allele, Count): no_pop (A, —|T, —)
SNP Type: INTRON Context (SEQ ID NO: 93):
ATGACACATGGAATTCTGGGCTAACAGTTGCTTCCATCTCTACAGGGCACCTTACTTCTG
GTAAGAAAATACAACTTAGGCTTTTTGAGTAGTCTTTTAGK
AATTGCCCATTTTAACCCATCATACTGAAAAAATCACATCAGGTGTTAAGTTTCTGGAC
AATAAGATATGCCTTATGTCTTCCATAGGAAAATAATAGAC
Celera SNP ID: hCV31222838
Public SNP ID: rs11465804
SNP Chromosome Position: 67475114
SNP in Genomic Sequence: SEQ ID NO: 14
SNP Position Genomic: 80357
SNP Source: dbSNP; HapMap
Population (Allele, Count): Caucasian (T, 111|G, 9)
SNP Type: TRANSCRIPTION FACTOR BINDING SITE; INTRON Context (SEQ ID NO: 94):
GAGGAGTTGCCATCTATTAATACTTATTTTCCACAAAATATTTTGGAAAGCCACTTCAAT
AGGATTTCACTCTTGGAAAAGTAGAGCTGTGTGGTCAAAAK
CAATATGAGAAAGCTGCCTTGCAATCTGAACTTGGGTTTTCCCTGCAATAGAAATTGAA
TTCTGCCTCTTTTTGAAAAAAATGTATTCACATACAAATCT
Celera SNP ID: hCV31222798
Public SNP ID: rs11465827
SNP Chromosome Position: 67497416
SNP in Genomic Sequence: SEQ ID NO: 14
SNP Position Genomic: 102659
SNP Source: dbSNP
Population (Allele, Count): Caucasian (T, 117|G, 3)
SNP Type: MICRORNA; UTR3

Context (SEQ ID NO: 95):
TAGAAGTGGCTCTGTTTCAAGCTCTGGTAAGCCTATTAGCTAACTCTTTCCCCAACCTCA
TGTCATCTGAACAAAGGGTTTCTAGGCTAAAAATAAAATAM
TTTTTAAAAGTTCAAAAACAACTGGTCAACAGAATAGAGTCTGAGTTCTGTAACACAAG
ACTTCTGTGATCTGATCCACTCACCATTCCAGCTTTACTCC
Celera SNP ID: hCV261079
Public SNP ID: rs10889676
SNP Chromosome Position: 67495155
SNP in Genomic Sequence: SEQ ID NO: 14
SNP Position Genomic: 100398
Related Interrogated SNP: hCV11283764 (Power = .51)
Related Interrogated SNP: hCV1272302 (Power = .51)
SNP Source: Celera; dbSNP
Population (Allele, Count): no_pop (A, —|C, —)
SNP Type: INTRON Context (SEQ ID NO: 96):
ACATTTTTTTCAATTTCATGGAAAAGAGGTTTTTCATTTTTCCAAAAATTGTACCAAGG
TAAAGCAAAGTTCTAGTTGATGCAGGTGCATTGTATAGGCR
TTAGCAATACTGCCCTCATTATGCACTCATTAGACAGTAGTGCAACCCCAAGAAAAGGA
TGGTTAGATATTTCTTTATAGCAATGCAAGAACAGCCTAAC
Celera SNP ID: hCV2720226
Public SNP ID: rs2863209

TABLE 2-continued

SNP Chromosome Position: 67505934
SNP in Genomic Sequence: SEQ ID NO: 14
SNP Position Genomic: 111177
Related Interrogated SNP: hCV31222786 (Power = .51)
SNP Source: dbSNP; Celera; HGBASE
Population (Allele, Count): Caucasian (G, 12|A, 106)
SNP Type: INTERGENIC; UNKNOWN Context (SEQ ID NO: 97):
ATTGAAAAGAAGCAGAGCAATAGAGATGAGAGGAAAATCTGAAAAGATAATGACACA
ATTTCCCACTTAATTTTCATTAAGTAAGAGATGAAAACTTTAGM
CTCGGCATCAGGAAGTTTGATTTCTTTAATTAATTTTTTTTTTGAGTCAGGGTCTCACTCT
GTTGCCCAGAGTGAGTGCAGTGGCATGGTCACAGCTCAC
Celera SNP ID: hCV2720251
Public SNP ID: rs11465817
SNP Chromosome Position: 67493685
SNP in Genomic Sequence: SEQ ID NO: 14
SNP Position Genomic: 98928
Related Interrogated SNP: hCV11283764 (Power = .51)
SNP Source: dbSNP; Celera; HapMap
Population (Allele, Count): Caucasian (C, 66|A, 42)
SNP Type: INTRON Context (SEQ ID NO: 98):
CCTTGAAGTCACTTCTGTCAGCTTTTAATTATCAGGAAGGAGGAGACTGGCAAGGCTGC
ACCAGGACCCCTTTGAGTTCAGACTGAAAGTTAGGTACCAGK
GTTGCTCACCCCACCCTGGTCAGAATCATTCATTAGCAGTTTCCTGACAGCCTTTATAAC
TAGACCAGGCTGCCAGGAAAAGAAAAGAGCAGAGAGAAGT
Celera SNP ID: hCV2990001
Public SNP ID: rs12030948
SNP Chromosome Position: 67474353
SNP in Genomic Sequence: SEQ ID NO: 14
SNP Position Genomic: 79596
Related Interrogated SNP: hCV2989999 (Power = .51)
SNP Source: dbSNP; Celera; HapMap
Population (Allele, Count): Caucasian (G, 78|T, 42)
SNP Type: INTRON Context (SEQ ID NO: 99):
CTAAATAAATAAATAAATAAAGTAAAATAAAGATAAAAGTCTTAAGCTTCAGGTAGAA
GGAAATAGGAACACCACAGTTTAAATTTAAGGTCTGTTTCCTR
AGGAGAAAAATCACTTAAGAGACAAAAATACCAATTAAAATTAAGTATCCCTGAAAAC
TTGGATTTATTAAAGTTTAACATGTTAGCTAAGAGAAACCAT
Celera SNP ID: hCV2990015
Public SNP ID: rs7528924
SNP Chromosome Position: 67461624
SNP in Genomic Sequence: SEQ ID NO: 14
SNP Position Genomic: 66867
Related Interrogated SNP: hCV27952715 (Power = .51)
SNP Source: dbSNP; Celera; HapMap; ABI_Val
Population (Allele, Count): Caucasian (G, 25|A, 95)
SNP Type: INTRON Context (SEQ ID NO: 100):
CAGCACTTTGAGAGGCCAAGGCAGGAAGATTGCTTGAGCCTAGGAGTTTGAGACTGGC
CTGGGCAACATAGTGAGACCCTAGTCTGTACAGAAAAATAATM
ATTATTATTAGCCTGGGTGGTAGAATGCATTTGTAGTCGCAGCTACTTGGGAAGCTGAG
GTAGTAGGATTGCGTGAGCCCGGGAGTTTGATGCTGCAGTG
Celera SNP ID: hCV2990016
Public SNP ID: rs11465802
SNP Chromosome Position: 67458186
SNP in Genomic Sequence: SEQ ID NO: 14
SNP Position Genomic: 63429
SNP Source: dbSNP; Celera
Population (Allele, Count): Caucasian (A, 89|C, 31)
SNP Type: INTRON Context (SEQ ID NO: 101):
ATGTCAAGAAACAGGCAAAAGGTACTGGCAGCCTTGGAGTTCACTGTTTTTTCATAAAA
CACCTGAAACAGGTGAGTGTACTTATATATTTTATTCTGTTR
GGCTTTTCTTTATATATCTTTTCTGCTGAGCACAGTGGCTCACACCTATAATTCCAGCAC
TTTGAGAGGCCAAGGCAGGAAGATTGCTTGAGCCTAGGAG
Celera SNP ID: hCV2990017
Public SNP ID: rs7518660
SNP Chromosome Position: 67458031
SNP in Genomic Sequence: SEQ ID NO: 14
SNP Position Genomic: 63274
Related Interrogated SNP: hCV30279129 (Power = .51)

TABLE 2-continued

```
SNP Source: dbSNP; Celera
Population (Allele, Count): Caucasian (G, 55|A, 59)
SNP Type: INTRON Context (SEQ ID NO: 102):
GTAATCTATCACACATGAAAAAAGCTTTTATCAAGCTTAAAGGATTACAGCATTGTTTG
ATCTTCTGCAAATGTTTCCACTGCAGCGAGTGCCTCCTTTTY
GCCCCCTAGAGTGGGAAGGAAGCTGCTTTCTCATTCTGTGGTGTCTTAACCCACATCACT
ATTCAGCACAAAGGAGACACTTCTGATTCTGTCTTTGCCA
Celera SNP ID: hCV11728628
Public SNP ID: rs2000252
SNP Chromosome Position: 67500143
SNP in Genomic Sequence: SEQ ID NO: 14
SNP Position Genomic: 105386
Related Interrogated SNP: hCV8367042 (Power = .51)
SNP Source: Celera; HGBASE; HapMap; dbSNP
Population (Allele, Count): no_pop (C, —|T, —)
SNP Type: INTERGENIC; UNKNOWN Context (SEQ ID NO: 103):
ACTCCAGCCTGGGCAATAGAGCGAGACTCCATCTCAAAAAAAGCAGTGTGTGTTTCAGT
TTTAATGTATTTCAGAGACAGTATTTGATTATGTACGGCCAY
GTTTTATATAAAGAACACTTTGTTTTCCTAGAGTCTAGAAGACAGCTTGGAACATAATA
GGTGTTCCATACATTTCTGCTAAATAAAATAGTTGTTTTAA
Celera SNP ID: hCV16078411
Public SNP ID: rs2863212
SNP Chromosome Position: 67457704
SNP in Genomic Sequence: SEQ ID NO: 14
SNP Position Genomic: 62947
Related Interrogated SNP: hCV2990018 (Power = .51)
SNP Source: dbSNP; HapMap
Population (Allele, Count): Caucasian (C, 12|T, 108)
SNP Type: INTRON Context (SEQ ID NO: 104):
TGAGCAAAGCCCCTGTCTTCATGGAGCTTCTATTCTAGCCAGACAGGGCAGAAAAACAG
CAAACAAAACAAGAAGAAAAGTCAGGTGGTGGTGAAGTGTCR
TAAAGAAACATGAAGTGGGTAGGCATGGTGGCTCACATTTTGTAATCCCAGCACTTTGG
GAGGCCAAGGCAGGCAGATTGCTTGAGTCCAGGAGTTTGAG
Celera SNP ID: hCV27868367
Public SNP ID: rs4655530
SNP Chromosome Position: 67476319
SNP in Genomic Sequence: SEQ ID NO: 14
SNP Position Genomic: 81562
Related Interrogated SNP: hCV2990018 (Power = .51)
Related Interrogated SNP: hCV31222825 (Power = .51)
SNP Source: dbSNP; HapMap
Population (Allele, Count): Caucasian (G, 14|A, 106)
SNP Type: INTRON Context (SEQ ID NO: 105):
TCCTTTTCTTCTGTCCTTCTCTGCCGAGCCATTCTGCCATTCTTCTGCTCTTCTATTTATCT
CTCTGTCTGCTTCTGGAACCTGGGGTCTGGAGTTTATGW
GGGTACAGGATAGCGGGGCATAGCAGGCCAAAAGGCAACTTTTTGAGCACGAAAACAAG
AATGCCTGCTTCTATTTAGGGCTATGGGTTTCCAAGCTTGAG
Celera SNP ID: hCV27868368
Public SNP ID: rs4655693
SNP Chromosome Position: 67464874
SNP in Genomic Sequence: SEQ ID NO: 14
SNP Position Genomic: 70117
Related Interrogated SNP: hCV2990018 (Power = .51)
Related Interrogated SNP: hCV31222825 (Power = .51)
SNP Source: dbSNP; HapMap; HGBASE
Population (Allele, Count): Caucasian (A, 15|T, 105)
SNP Type: INTRON Context (SEQ ID NO: 106):
TTTGCAATTCTAGAATCGGACAACACCTCATACTATAAAACAGAGTGAGTGTTCTGATG
AGCTGAGCAGAGGAGGTTGATTTAAGGAACTTTCTTATCACR
CTGGCGAAAACTGGCCTGTTTAGGGATTTGGCTGTTATCTCTGTGTCCTGATTTGTTGAA
AGGTCAGATAAAGATCTTAGTTTCAGCAGGTTAGTGTGGA
Celera SNP ID: hCV30423493
Public SNP ID: rs7539328
SNP Chromosome Position: 67505191
SNP in Genomic Sequence: SEQ ID NO: 14
SNP Position Genomic: 110434
Related Interrogated SNP: hCV31222784 (Power = .51)
SNP Source: dbSNP; HapMap
Population (Allele, Count): Caucasian (G, 76|A, 42)
SNP Type: INTERGENIC; UNKNOWN
```

TABLE 2-continued

```
Context (SEQ ID NO: 107):
ATTCCAATGTGATAAGTAATGCCTCAACTATCTTCTATATTTGAAAATAGGGCTTTTTCA
TGTACCAGGGAGAAAGCATGATGAGCCTGGTGGGTAATATR
TGTTGAATAAATTATATTAATTATTTAAATATTTTAGGAGATTAACTCAACTTTGACATG
CAAGAAAAGCATTGGTTTTGTTTGTTTGTTTGTTTT
Celera SNP ID: hCV31222830
Public SNP ID: rs12751814
SNP Chromosome Position: 67477451
SNP in Genomic Sequence: SEQ ID NO: 14
SNP Position Genomic: 82694
Related Interrogated SNP: hCV31222826 (Power = .51)
SNP Source: dbSNP
Population (Allele, Count): Caucasian (G, 50|A, 66)
SNP Type: UTR5; INTRON Context (SEQ ID NO: 108):
CCCTTATAAATATTTAAATGTCCAATCAGGTAGCCAAATGTACCTGAAGCTTTGATTGTT
TTCCCAGGAATATGGGTTTGACAAGCCAAATATTGTTTATR
ACTATTTTAGTAGTTTATAAGTCACCACACAAACATATTTAATTTGGATCATTTTATCTT
TTCCATTACAAGTCGTAAAATGCAGAACTTTTAATAATGA
Celera SNP ID: hCV29503362
Public SNP ID: rs6682033
SNP Chromosome Position: 67481258
SNP in Genomic Sequence: SEQ ID NO: 14
SNP Position Genomic: 86501
Related Interrogated SNP: hCV8367042 (Power = .51)
SNP Source: dbSNP; HapMap
Population (Allele, Count): Caucasian (A, 82|G, 38)
SNP Type: INTRON Context (SEQ ID NO: 109):
CTTACCTATCTTGTGCTAGGACTTGTCTAGACATCTTCTTCAATCTTTAAAACAACCCAT
GAGATAAGTGTTACGCATCTATTTTATAATGAGGAAACTGM
AACTTAGAGTAGTTGAGGAAACTTTTCAAGGTCATAGAGCTGCTAAGTGACAGACTAAA
ATTCAAATCCTTTTCTTTCAATGTCCTGGAGTCTATTGTCT
Celera SNP ID: hCV31222834
Public SNP ID: rs11465810
SNP Chromosome Position: 67475773
SNP in Genomic Sequence: SEQ ID NO: 14
SNP Position Genomic: 81016
SNP Source: dbSNP
Population (Allele, Count): Caucasian (A, 81|C, 39)
SNP Type: INTRON Context (SEQ ID NO: 110):
AGGTCATTTCCATTTTATCCATTATCAATAAACTTCTTTGCATAGCTTTGTATATAAATG
GTCTTTATTCCTTTAGTTCTAAAGAAGAATTATTGCATCAR
GAGTTAAGCACCTTTTAAGATGCTGATGTATGTTGTCGAACTGCTTTTTACCGAATCTTT
AATATTGATTGCTTTTTAAAAAGGGACCTATGAAAAGACA
Celera SNP ID: hDV81067815
Public SNP ID: rs41396545
SNP Chromosome Position: 67462196
SNP in Genomic Sequence: SEQ ID NO: 14
SNP Position Genomic: 67439
Related Interrogated SNP: hCV8367043 (Power = .51)
SNP Source: dbSNP
Population (Allele, Count): no_pop (A, —|G, —)
SNP Type: INTRON
Gene Number: 3
Gene Symbol: RNF145-153830
Gene Name: ring finger protein 145
Chromosome: 5
OMIM NUMBER:
OMIM Information:
Genomic Sequence (SEQ ID NO: 15)
SNP Information Context (SEQ ID NO: 111):
TAATCAAGAATCTTTCAGATGCTCCTAATTGGGCTGAAAATAGCAGCTGTTTTGAAACT
GCAAAAATGAATGGTACCATAACTGTGAAATAAAAATGAACY
ATAACTTTAATGTACTTAACATTTATGTAGAATTTTATCTACCTGTTTGTGGTTGTCAGC
AGTCTTACCTGAACCAATTCTCTGTATGCAGATTTAGCAA
Celera SNP ID: hCV7538686
Public SNP ID: rs1473247
SNP Chromosome Position: 158536149
SNP in Genomic Sequence: SEQ ID NO: 15
```

TABLE 2-continued

SNP Position Genomic: 72729
SNP Source: dbSNP; HapMap
Population (Allele, Count): Caucasian (T, 93|C, 27)
SNP Type: INTRON Context (SEQ ID NO: 112):
ATATCTTTACTTCATTTCCTTTATCCAATCCTCCATTGATGGAGACAGTCAGGTTAACTC
CATGTCTTTGCTATTGTGCATAGTGCTCTGATAAGCATATY
AGTGCAAATATCTTTTTTTATATAATTGTTTCTTTCCCTTTGGGTTTATACCCAGTAGCAG
GATTGCTGGATCAAATGGTAGTCCTATTTTTAGTTCTTT
Celera SNP ID: hCV1030180
Public SNP ID: rs270659
SNP Chromosome Position: 158493420
SNP in Genomic Sequence: SEQ ID NO: 15
SNP Position Genomic: 30000
SNP Source: dbSNP; Celera; HapMap; HGBASE
Population (Allele, Count): Caucasian (T, 97|C, 21)
SNP Type: INTERGENIC; UNKNOWN Context (SEQ ID NO: 113):
CATCCTGGGCCACACGCAGCCCAGGAGTTGGACAAGCTTAGTCTACAATTTCAAAGAA
GTAACTTGCTGAGGTAACATATTTACTAGGTAAGGAAACAATY
TGTATCAAGTCTGATTCTAAAGTTAATTTTCCTTTCTACTAACCATGCTGCCTACCTAAG
TGGAATGAACTAGATTGTGAAAACATGGATTCAAGTTAAA
Celera SNP ID: hCV2081970
Public SNP ID: rs1897565
SNP Chromosome Position: 158550843
SNP in Genomic Sequence: SEQ ID NO: 15
SNP Position Genomic: 87423
SNP Source: dbSNP; Celera; HapMap; ABI_Val; HGBASE
Population (Allele, Count): Caucasian (T, 93|C, 27)
SNP Type: INTRON Context (SEQ ID NO: 114):
GGTTACTAACAGCACTGAACATTATCAATAAGTATATGAAAACATTTGCAATTATTTGG
TGAAATGTTCACATTCTTTGCCCATTTTTCTGCTAGAATACR
TATCCTACTGCCTGATCGAAATAGTAATCCTTAGTCACATGATTGCATTTTTCTAATATG
TCCCTTGTCTTAATATTTTAAATAACTTTATTCTCTTATA
Celera SNP ID: hCV2081982
Public SNP ID: rs10076782
SNP Chromosome Position: 158537541
SNP in Genomic Sequence: SEQ ID NO: 15
SNP Position Genomic: 74121
SNP Source: dbSNP; Celera; HapMap
Population (Allele, Count): Caucasian (G, 93|A, 27)
SNP Type: INTRON Context (SEQ ID NO: 115):
GAATGTATGTGACATGATATTTGCATTTAGCCCTTTCCAAATATTCCATAATTATAAAAT
GCTTTGTATGAATAAGCTTTTACATTATGACATCCTTGTAY
AAACTACTTGGAACACATTTCCTAATATTCTCTTAGGCTAGGAATTACTGAATCAGAAA
AAAACATTTTTAAAGACTTTGACACACTGTCAAGACTGCCC
Celera SNP ID: hCV2081983
Public SNP ID: rs17663721
SNP Chromosome Position: 158537218
SNP in Genomic Sequence: SEQ ID NO: 15
SNP Position Genomic: 73798
SNP Source: dbSNP; Celera; HapMap
Population (Allele, Count): Caucasian (T, 96|C, 24)
SNP Type: INTRON Context (SEQ ID NO: 116):
ATTTATGAAGATTTTCCCTTTAACAATTATTTCATTAATAGAAAAGTTGTTTCATGAACT
ATTAGTATCATCTCTTAATTGTCCTCTAACTTGAGAATTAS
GACGCTTTTCCTTTCCTTTTTTAATTCCCAGTACACTGAATTGAATTCATCACAATCCTTG
ATTGACGATGTACTGTCATCATTTGTCTGTGCATGTCCC
Celera SNP ID: hCV2081991
Public SNP ID: rs13178603
SNP Chromosome Position: 158524593
SNP in Genomic Sequence: SEQ ID NO: 15
SNP Position Genomic: 61173
SNP Source: dbSNP; Celera; HapMap
Population (Allele, Count): Caucasian (G, 96|C, 24)
SNP Type: TRANSCRIPTION FACTOR BINDING SITE; INTRON Context (SEQ ID NO: 117):
GCTTTCTACCAACAGATGTGCAGGGTATTTTTCCCTCTGCCCTTGTTTGTTCATTAATCCA
TGGTAGGGGACACCAATGGATGGTCACAGTTATGATTCCY
CCCATCAATGTGTTTTGCTTGGTTTTCATAGCATTTTTAATTATTTATTTTTGGAGACAGA
GTCTCATTCTGTCACCCAGGCTGGAGTACAGTGGCGTGA TABLE 2-continued

```
Celera SNP ID: hCV3220380
Public SNP ID: rs270654
SNP Chromosome Position: 158497687
SNP in Genomic Sequence: SEQ ID NO: 15
SNP Position Genomic: 34267
SNP Source: dbSNP; HapMap
Population (Allele, Count): Caucasian (T, 109|C, 11)
SNP Type: INTERGENIC; UNKNOWN Context (SEQ ID NO: 118):
AGCTTGAAGAGACTAAGAGCAGGCAATCCAAGTCTCCTCCACATGTGGAAACCAAGTC
CAGAGACGGAGCAGTAACTGCCCGGCTCCCACGGCTTGTAATY
GCAGAAACAAGCTTTAAGCCGGCTGCCTCCTTCCTCGTTGCTTTTACCATTATTTAATTT
GTAGGCTTCACAAAGGCTATATGTGTTGAAATTGGCTAAA
Celera SNP ID: hCV3220386
Public SNP ID: rs270661
SNP Chromosome Position: 158492732
SNP in Genomic Sequence: SEQ ID NO: 15
SNP Position Genomic: 29312
SNP Source: dbSNP; Celera; HapMap; ABI_Val; HGBASE
Population (Allele, Count): Caucasian (C, 95|T, 25)
SNP Type: INTERGENIC; UNKNOWN Context (SEQ ID NO: 119):
AGTAGGACTATAATCAGAAGGAAAAAGCAGGATTTGACTTATAGGTATTCAATTCTTTA
TTATTTTTGTCTTCATTACAATAGCTAACACATATGGAACAY
TGTCTGCCTGGTACTAAACTCATTTAAATCTCACAGAACTCTATGAGGAAAGCACAGCT
TTCATTATTAGCTCCGTTTTACAGAAAGTAACGCAATTATC
Celera SNP ID: hCV11270803
Public SNP ID: rs13158488
SNP Chromosome Position: 158535849
SNP in Genomic Sequence: SEQ ID NO: 15
SNP Position Genomic: 72429
SNP Source: dbSNP; Celera; HapMap
Population (Allele, Count): Caucasian (T, 96|C, 24)
SNP Type: INTRON Context (SEQ ID NO: 120):
ATAAAAAGACACACAGTCCTCTCCTTCCCTTTCAGACTAGTTTCCTCTTTACTGCAGACT
GCGACGCAAGGCCATCCACTAATCTTTGATGCCTGCTCACY
GCACAGGCCCCTTCCTCTCTCCCCGCACCTCCTCCCACAACGCCTGCAGATCTCAGATGC
GTTTGAACTACAGTAACCCCAACCCAGCTCGCGGCAAGCA
Celera SNP ID: hCV27841092
Public SNP ID: rs6556405
SNP Chromosome Position: 158567680
SNP in Genomic Sequence: SEQ ID NO: 15
SNP Position Genomic: 104260
SNP Source: Applera
Population (Allele, Count): Caucasian (C, 13|T, 25) African American (C, 17|T, 11) total (C, 30|T, 36)
SNP Type: UTR5; INTRON
SNP Source: dbSNP; Applera
Population (Allele, Count): Caucasian (T, 89|C, 27)
SNP Type: UTR5; INTRON Context (SEQ ID NO: 121):
GCCAAAAATACTATTGACACAAACATGCATCACAACTCACTCTACAGCATTAACCAAAC
AATCCATAACAAACTAAGTTGACAATGGCAAAGCTGTTAGTK
TTTAAATTATACACAGTAATTTGTAATTAAAAAGCAAGACCAGTGGCATTTAAAAATGA
TGACCTAGGCCAGGTGTAGTAGTGCACACCTATAATCCCAG
Celera SNP ID: hCV30377542
Public SNP ID: rs6888950
SNP Chromosome Position: 158557329
SNP in Genomic Sequence: SEQ ID NO: 15
SNP Position Genomic: 93909
SNP Source: dbSNP
Population (Allele, Count): Caucasian (T, 90|G, 24)
SNP Type: INTRON
Gene Number: 4
Gene Symbol: UBLCP1-134510
Gene Name: ubiquitin-like domain containing CTD phosphatase 1
Chromosome: 5
OMIM NUMBER:
OMIM Information:
Genomic Sequence (SEQ ID NO: 16)
SNP Information Context (SEQ ID NO: 122):
GTCCACCCCCTGACAATGATGATGTTGTTAATGACTTTGATATTGAAGATGAAGTAGTT
GAAGTAGAAAATAGGTAAGTGCTTTTCGCTTTAGAAGTAATS
AGTTGTCATGTGAGAACAAGTGAATATTTTATCTAATTATATGTTTTCCATTAGGGAAGA
```

TABLE 2-continued

```
AAACCTACTGAAAATTTCTCGCAGAGTGAAAGAGTACAAA
Celera SNP ID: hCV2084255
Public SNP ID: rs3734104
SNP Chromosome Position: 158630059
SNP in Genomic Sequence: SEQ ID NO: 16
SNP Position Genomic: 62850
SNP Source: Applera
Population (Allele, Count): Caucasian (C, 10|G, 22) African American (C, 25|G, 11) total
(C, 35|G, 33)
SNP Type: INTRON; PSEUDOGENE
SNP Source: Applera
Population (Allele, Count): Caucasian (C, 14|G, 18) African American (C, 25|G, 7) total (C, 39|G, 25)
SNP Type: INTRON; PSEUDOGENE
SNP Source: dbSNP; Celera; HapMap; HGBASE
Population (Allele, Count): Caucasian (G, 53|C, 67)
SNP Type: INTRON; PSEUDOGENE Context (SEQ ID NO: 123):
GGAAAGTTTTCGGAGTTTTACAGCAAGAAAAACACCATTATGTTTGATGACATAGGGAG
AAATTTTCTAATGAACCCACAGAATGGACTAAAGGTAAGACR
TACTTTTACTTGTTATGTGCTCATGTAATCTGGGCTGTGTGGTAGAACTTTTGTAGTAAG
CACTGTTGAATTTCATATATTTTTGGAAGTACTGTATTCT
Celera SNP ID: hCV25633374
Public SNP ID: rs12520035
SNP Chromosome Position: 158637948
SNP in Genomic Sequence: SEQ ID NO: 16
SNP Position Genomic: 70739
SNP Source: Applera
Population (Allele, Count): Caucasian (A, 35|G, 5) African American (A, 29|G, 3) total (A, 64|G, 8)
SNP Type: INTRON
SNP Source: dbSNP; HapMap
Population (Allele, Count): Caucasian (A, 112|G, 8)
SNP Type: INTRON Context (SEQ ID NO: 124):
TTGGATCTAAATCACAAATATTGGGAAAGGTAAGTTTTAATTGCTTATTTATTTTCTCTT
TACATCAATGAAGAAAAAATTATCATTTTTCATCAGTGACY
CCAGTATATATATAGCTGTCTTAATTTTTATTTAAAATAGGTGACTTCTAAAAACATTTT
CTAATCCAGTGACCTACCCCCAAAAGTATTTTCCCCTTTC
Celera SNP ID: hCV7537829
Public SNP ID: rs1433046
SNP Chromosome Position: 158642997
SNP in Genomic Sequence: SEQ ID NO: 16
SNP Position Genomic: 75788
SNP Source: Applera
Population (Allele, Count): Caucasian (C, 10|T, 24) African American (C, 17|T, 5) total (C, 27|T, 29)
SNP Type: INTRON; PSEUDOGENE
SNP Source: dbSNP; HapMap; HGBASE
Population (Allele, Count): Caucasian (C, 53|T, 67)
SNP Type: INTRON; PSEUDOGENE Context (SEQ ID NO: 125):
GAGAAGTATGTAAACAGCTAACTATATTTTGTTAAAGATTTATAGGAACATTTTCACAT
GACAAAGAAGTTCCCAACCACTGTGGACCCTCACTGGTGCCS
AGATGTCTGTGGTTATTGGTCATCTCTTGATCTCAACTCCCTCCTTGTCCCCTTACCCTTA
CACAAAAGAGCCTAAAATTTGTCTTGACTTAAGATGGT
Celera SNP ID: hCV1030157
Public SNP ID: rs254837
SNP Chromosome Position: 158615778
SNP in Genomic Sequence: SEQ ID NO: 16
SNP Position Genomic: 48569
SNP Source: dbSNP; HGBASE
Population (Allele, Count): Caucasian (G, 7|C, 99)
SNP Type: INTRON Context (SEQ ID NO: 126):
TGTAACCACATTTTGGATTATTTCAAGGTCCAATGTGATACAAAAGTTGGAGAAATTGA
AAATAAATTTTATAAAAATTATAATGAAGAAATATACAGCAW
AGAAGAATAAAAGGGAAACAATAAAGGGTTAAAAGTACAGATTCCAGAGCTGTCCAGT
TCAGCAGCCACTAGCCACATGTGGCTATTGAGCATTTGAAAT
Celera SNP ID: hCV1030159
Public SNP ID: rs254839
SNP Chromosome Position: 158607721
SNP in Genomic Sequence: SEQ ID NO: 16
SNP Position Genomic: 40512
SNP Source: dbSNP; HapMap
Population (Allele, Count): Caucasian (T, 94|A, 24)
SNP Type: INTRON
```

Context (SEQ ID NO: 127):
ACAACTTGAAAACAGAAGCAATGCACCTTCAGAATTGATCCTGCCTCCCAAGAAGCCTA
CTTCCAAAGATCAGAATCATAAAATGCATTTTTGCTGTCTTY
GTAAGCAATTTTGATATTTTGTCAGTTTCATTGCTATTAAGTGATCATTCCTTGCTTCAA
ATGAAAGCTAGAGAGAATTACAATTCTTATGATACTGTTT
Celera SNP ID: hCV1030161
Public SNP ID: rs254843
SNP Chromosome Position: 158605897
SNP in Genomic Sequence: SEQ ID NO: 16
SNP Position Genomic: 38688
SNP Source: dbSNP; HapMap; HGBASE
Population (Allele, Count): Caucasian (C, 95|T, 25)
SNP Type: INTRON Context (SEQ ID NO: 128):
CTTCCCGAGGTATGGAAGGATTGTGAATCTACTCAGTCAATCTTAAAAGGGGCAATGGG
GAGAGGGAAAACAAGGAACCCTCACAGGCTAATTTTTAAACY
ACATCTCTTAAGAAAATATGGAGAAGCAAAGAGAGGAAAATGTAAATTACCTGAAATT
CTACCACTGTAAATATGTTGATATACTTTCAGACTTTTTCCT
Celera SNP ID: hCV1030169
Public SNP ID: rs254850
SNP Chromosome Position: 158599309
SNP in Genomic Sequence: SEQ ID NO: 16
SNP Position Genomic: 32100
SNP Source: dbSNP; Celera; HapMap; HGBASE
Population (Allele, Count): Caucasian (C, 95|T, 25)
SNP Type: INTRON Context (SEQ ID NO: 129):
CCTCCAGAGTTATATACAAATTGTAATCATTCATTGATATGTATTGTTACAAGCGTAATA
TGTACAGCTGGCCCTCTGGATCCACAGGTTCCAAAACTACR
GATTCAACCAACCTCGGGTTTGAAGTATTAGGGGAAAAACCCAAAGATAATAAGACAA
CAATAAAAAATAATGGAAGTAAAAGCAATACAGTATACCAAC
Celera SNP ID: hCV2081927
Public SNP ID: rs194228
SNP Chromosome Position: 158619371
SNP in Genomic Sequence: SEQ ID NO: 16
SNP Position Genomic: 52162
SNP Source: dbSNP; Celera; HapMap; HGBASE
Population (Allele, Count): Caucasian (G, 67|A, 53)
SNP Type: INTRON Context (SEQ ID NO: 130):
TAAATAAAATATCACATCTATTATATTTACATGCATTAATAATAGCTTATTGGGAATATT
ATTATGGGAAAGTCATGAGGATAAAAAAGTTATAGTTTAGW
TTCACCATGTTTAAAATCATAATAATACGGCTGGGCGTGGTGGCTCATGCTTGTAATCCC
AGAACTTTGGGAAGGCCAAGGCGGGTGGATCACGAGGTCA
Celera SNP ID: hCV2081932
Public SNP ID: rs4921200
SNP Chromosome Position: 158610802
SNP in Genomic Sequence: SEQ ID NO: 16
SNP Position Genomic: 43593
SNP Source: dbSNP; Celera; HapMap; HGBASE
Population (Allele, Count): Caucasian (T, 25|A, 95)
SNP Type: INTRON Context (SEQ ID NO: 131):
CTGGGATTACAGGCATGAGCCACCACGCCCAGCCAAGTAGGCCATCTTTTGATCCATGT
TTCAGCTAACCAAGCAAATAAATTATTAGAACCTTTTTTAW
CTCCCTGATCTGCAACATTAAATGCAGAATCCCTGCTTAGTGGGTCCATATCAGTAAATT
CAGCCTGATCCAACTTTATGTTCTTTCCACCATTATCCCA
Celera SNP ID: hCV2081943
Public SNP ID: rs254852
SNP Chromosome Position: 158596372
SNP in Genomic Sequence: SEQ ID NO: 16
SNP Position Genomic: 29163
SNP Source: dbSNP; Celera; HapMap
Population (Allele, Count): Caucasian (T, 95|A, 25)
SNP Type: UTR5; INTRON Context (SEQ ID NO: 132):
AGGTGAGGAGGACTGACCTTGTTAAAACACAGATTCCTAGGTCCCTTCTCTCCACCCCA
ATTACATTTCTACCAAATTACCAAGTGAGGTCAATGCTGTTS
GTTAGCCCAGGGACCATGCTTTGAAAACCACTAGTCTAGAAGAGCAATCACTTGTCCAG
GGTCACCTGGAACTCAGATGATTTCACTCCAAACTCTGCAC
Celera SNP ID: hCV2084251
Public SNP ID: rs10515780
SNP Chromosome Position: 158624371
SNP in Genomic Sequence: SEQ ID NO: 16

TABLE 2-continued

```
SNP Position Genomic: 57162
SNP Source: dbSNP; Celera; HapMap
Population (Allele, Count): Caucasian (C, 25|G, 93)
SNP Type: INTRON Context (SEQ ID NO: 133):
CTTGTTAAAACACAGATTCCTAGGTCCCTTCTCTCCACCCCAATTACATTTCTACCAAAT
TACCAAGTGAGGTCAATGCTGTTCGTTAGCCCAGGGACCAY
GCTTTGAAAACCACTAGTCTAGAAGAGCAATCACTTGTCCAGGGTCACCTGGAACTCAG
ATGATTTCACTCCAAACTCTGCACTACTACGCATCACAATA
Celera SNP ID: hCV2084252
Public SNP ID: rs10866711
SNP Chromosome Position: 158624388
SNP in Genomic Sequence: SEQ ID NO: 16
SNP Position Genomic: 57179
SNP Source: dbSNP; Celera; HapMap
Population (Allele, Count): Caucasian (T, 25|C, 93)
SNP Type: INTRON Context (SEQ ID NO: 134):
ATTTGTCCATTTGAAGATATTATGATTTATACTACACTGTTGTATTATAGTTTTAATTGTG
GTAAAATTGTCAGTCTAGCAATCAATGAAAAATAAAACCN
GCACCGTGAATGTGTTATTAACTGTATAAGTATAGTAGTAGCACAAATGATCAAATTTA
ATATGGTAAATCTGCCCAGGAAACATACATAACGAATTATT
Celera SNP ID: hCV2084254
Public SNP ID: rs2420825
SNP Chromosome Position: 158629709
SNP in Genomic Sequence: SEQ ID NO: 16
SNP Position Genomic: 62500
SNP Source: dbSNP; Celera; HapMap; ABI_Val
Population (Allele, Count): no_pop (C, —|T, —)
SNP Type: INTRON; INTERGENIC; UNKNOWN Context (SEQ ID NO: 135):
ATAAGGGACTGTAGCTCGTCATTTGATGTAGTAGGATATGTAATGATTTAGAAATTTTC
ATGACACATTTAAGTGAAAGAAGTATTTTAGAGAACACTGTY
GTAAGCCGTTAGAAAATAGTTCTTAACCTTTGTTTGGTTCAGGATTACCCTTAATTTAAC
AAAGAACCTGTCAACTCTCTGAGGCTGCTCTTGTTTATAA
Celera SNP ID: hCV2084259
Public SNP ID: rs7708700
SNP Chromosome Position: 158636313
SNP in Genomic Sequence: SEQ ID NO: 16
SNP Position Genomic: 69104
SNP Source: dbSNP; Celera; HapMap; ABI_Val
Population (Allele, Count): Caucasian (T, 26|C, 94)
SNP Type: INTRON Context (SEQ ID NO: 136):
GCCTAGGCTGGTCTCGAGGTCCTGCACTCAAGCGATCCACCTATCTCGGCCTCTCAAAG
TGCAGGATTACAGGCATGAGCCACTGCGCCCAGCCCAGAAAK
AGTTCTAAAATGGAGAAATATCCTCAAATGCTGTGTTTTGTTATCATGCTTTCATAATGC
ACTTGGTAGAAATCTCAAAGATTTCATGTAGATCTTAAAA
Celera SNP ID: hCV2084262
Public SNP ID: rs17665189
SNP Chromosome Position: 158640194
SNP in Genomic Sequence: SEQ ID NO: 16
SNP Position Genomic: 72985
SNP Source: dbSNP; Celera; HapMap
Population (Allele, Count): Caucasian (G, 53|T, 67)
SNP Type: INTRON Context (SEQ ID NO: 137):
ATCATATTATCTAAAATTAATTTAAAATTATTGAAAGACTATCTTGAGTTGTATAAAGAT
ATTTGAGCAGGTGTCTTTTACAAAACAGCAGAATTCTTTAY
TGAAGCTATAAAATAAGGAAAAGTGCATAAATTTATAGTTCAACAAACTGTAAAGATA
ATTCTTGTAAAAAATTTTATTCCACTAAAATTACTCATGATT
Celera SNP ID: hCV2084263
Public SNP ID: rs10515782
SNP Chromosome Position: 158641855
SNP in Genomic Sequence: SEQ ID NO: 16
SNP Position Genomic: 74646
SNP Source: dbSNP; Celera
Population (Allele, Count): Caucasian (C, 26|T, 94)
SNP Type: INTRON; PSEUDOGENE Context (SEQ ID NO: 138):
TAAACTCTTTTTCATCATAAAATAGATCAGCCTTAAACATTTGGAAAATATGGCAGTTCT
TTTTATGGAAAACTCTTGCATAATTAAAAATGATTTTAACR
GAGAATTTAATGATAAAGAAAAATGCTTATGATAAAATGTAGGAGGAAACAGGTTATA
TAAATGTATAATGATATCTCAGCTATATAAAAATTTAATAGA
```

TABLE 2-continued

```
Celera SNP ID: hCV2084265
Public SNP ID: rs7736656
SNP Chromosome Position: 158642268
SNP in Genomic Sequence: SEQ ID NO: 16
SNP Position Genomic: 75059
SNP Source: dbSNP; Celera; HapMap
Population (Allele, Count): Caucasian (A, 26|G, 94)
SNP Type: INTRON; PSEUDOGENE Context (SEQ ID NO: 139):
TGGAATATAATCCCTCTTCTCATACTGTAACTTAATGTCAGGATAAGATAAAACACATG
TAAAAATTTCATAAATAGTATTAAAAATTACCAGTAACTTGW
GTGTAGCAGAGAAATTAGAAAAGTTTATCCTACTAAAAAAACAATTACTCATAATTTTC
CTTTTTAAAGATAACCACTGTTACCATCTTGGTATATAGTC
Celera SNP ID: hCV2084266
Public SNP ID: rs10042630
SNP Chromosome Position: 158643346
SNP in Genomic Sequence: SEQ ID NO: 16
SNP Position Genomic: 76137
SNP Source: dbSNP; Celera; HapMap
Population (Allele, Count): Caucasian (A, 26|T, 94)
SNP Type: INTRON Context (SEQ ID NO: 140):
CAAAGGCCCCCTTCCATTTCTCCTCTCCAGAGTGTTCCAGTAAGAACATCCCCTTCTAGC
TATTTCACACATGGACAACCAAGAAATAGTCATTTACAGAR
CATTTTGCATTTGTACAATTTCACTCGTTATTTCTCCCCAGTACCTAATGGGGCTGCA
GCGTGTACTCTGTTCGTGGTTAAATTCTGCTGCCAGAAGT
Celera SNP ID: hCV2084270
Public SNP ID: rs2082412
SNP Chromosome Position: 158650367
SNP in Genomic Sequence: SEQ ID NO: 16
SNP Position Genomic: 83158
SNP Source: dbSNP; Celera; HGBASE
Population (Allele, Count): Caucasian (G, 93|A, 27)
SNP Type: INTERGENIC; UNKNOWN Context (SEQ ID NO: 141):
TCCCATGATGGTCAAGGAATAATTTTGGAGGAGACGTTTAACTTTAAAAAAAAAAATAC
AATCATTAGTTTCATGTTTGTTTAAAAGAAACTTTGTTTTCS
TAACCAACATTTGAGCTCCATTCATCTCTTGATGCAGGGAGAGATGTTATTGTAAATGTC
TAGTTCTTTATGTTACTTTACAGTAGGGTTTTTAAAAGAC
Celera SNP ID: hCV7537756
Public SNP ID: rs1368437
SNP Chromosome Position: 158639557
SNP in Genomic Sequence: SEQ ID NO: 16
SNP Position Genomic: 72348
SNP Source: dbSNP; Celera; HapMap; ABI_Val; HGBASE
Population (Allele, Count): Caucasian (C, 112|G, 8)
SNP Type: INTRON; PSEUDOGENE Context (SEQ ID NO: 142):
ATAAAAAGACACACAGTCCTCTCCTTCCCTTTCAGACTAGTTTCCTCTTTACTGCAGACT
GCGACGCAAGGCCATCCACTAATCTTTGATGCCTGCTCACY
GCACAGGCCCCTTCCTCTCTCCCCGCACCTCCTCCCACAACGCCTGCAGATCTCAGATGC
GTTTGAACTACAGTAACCCCAACCCAGCTCGCGGCAAGCA
Celera SNP ID: hCV27841092
Public SNP ID: rs6556405
SNP Chromosome Position: 158567680
SNP in Genomic Sequence: SEQ ID NO: 16
SNP Position Genomic: 471
SNP Source: Applera
Population (Allele, Count): Caucasian (C, 13|T, 25) African American (C, 17|T, 11) total (C, 30|T, 36)
SNP Type: UTR5; INTRON
SNP Source: dbSNP; Applera
Population (Allele, Count): Caucasian (T, 89|C, 27)
SNP Type: UTR5; INTRON Context (SEQ ID NO: 143):
AGGGAATTGTGGGGTCAGAGCCCCCATACAGAGTCCCTACTGGGGCACTGCCTAGTGG
AGCTGAGAGAAGAGGGCCACCACCCTCCAGGCCCCAGAATGGS
AGATCTGACAACAGCTTGTACTGTGTGCCTGGAAAATCCACAGACACTCAATGCCAGCC
CGTGAAAGCAGCTGGGAGGGAGGGTTTACCTTGCAAAGCCA
Celera SNP ID: hCV27883435
Public SNP ID: rs4921442
SNP Chromosome Position: 158626678
SNP in Genomic Sequence: SEQ ID NO: 16
SNP Position Genomic: 59469
```

TABLE 2-continued

```
SNP Source: dbSNP; HapMap
Population (Allele, Count): Caucasian (C, 88|G, 26)
SNP Type: INTRON Context (SEQ ID NO: 144):
ATTCCCAAAGTGTTACTTTTACTGCTATACTTTAAAATTTCTTCATTTGCCACTTTTTAGG
TTTGTGGTCCCGGGCAAGTTTAATTTCTTTTCAGGATTCY
CATTTGTATAATGAGGACAACAGCTGTTGGTTCAGGATTGTGAAGCTTCAATGAGATAA
TTGTTTAGCATGTTTTTATTCCATCATGAACACCATTTGTA
Celera SNP ID: hCV27936085
Public SNP ID: rs4921437
SNP Chromosome Position: 158623529
SNP in Genomic Sequence: SEQ ID NO: 16
SNP Position Genomic: 56320
SNP Source: dbSNP; HapMap; ABI_Val; HGBASE
Population (Allele, Count): Caucasian (T, 26|C, 94)
SNP Type: INTRON Context (SEQ ID NO: 145):
GGATTACACAAATGTGTGAACAGCAGAAGGTAGAAACATTGAGGGTTATGGTACAGTC
TGTTTGCCACAATCCCTGAATCCATTCTTTAAAAAGTTGGTAK
AAAAATACCTACTTTAGAGGGTTGTTATGTGAATTCAAAACAAGATAACATATATCGAG
TGTTTACGTGGTACCTGGCACATAGTGAGCATTCAATAAAT
Celera SNP ID: hCV30557642
Public SNP ID: rs10056599
SNP Chromosome Position: 158655488
SNP in Genomic Sequence: SEQ ID NO: 16
SNP Position Genomic: 88279
SNP Source: dbSNP; HapMap; ABI_Val
Population (Allele, Count): Caucasian (T, 93|G, 27)
SNP Type: INTERGENIC; UNKNOWN Context (SEQ ID NO: 146):
CCGATAGTGCCCACGGTGAACCCGTATTATTGTTCCTCTATCAGGTAGCTCAATATATAT
GAAAAGATAGTGGAATCTGCTAGGTGATACAGGTGAGGGAR
GATCCTTTGATTTGAGTTGATGACAGGAATTCAGCTGAGTCATGTTTTAGGATGCAGGC
TCATACCTAGAACCATCTTGAAAGTACCATCTGGGAGCAAG
Celera SNP ID: hCV31985608
Public SNP ID: rs12652431
SNP Chromosome Position: 158654672
SNP in Genomic Sequence: SEQ ID NO: 16
SNP Position Genomic: 87463
SNP Source: dbSNP; HapMap
Population (Allele, Count): Caucasian (A, 94|G, 10)
SNP Type: INTERGENIC; UNKNOWN Context (SEQ ID NO: 147):
GACTTTTCAGGAATCTAGAGGTAAATCAATTATTTAATTGAATACAAATCCCTCTTACTT
TTATTCCCAGTTCTTAATTCTCTGGAGCACTGATTGCTATY
ACTTCTTGTTGGATAATCTGTGAGGAGAACTGCTGTAGCTTCCTAAATAAGGCTTTTGAA
AGAGCCAGTGGTTTGTCAGAAAAACATGTGACTAAAATCC
Celera SNP ID: hCV30629526
Public SNP ID: rs4921458
SNP Chromosome Position: 158648241
SNP in Genomic Sequence: SEQ ID NO: 16
SNP Position Genomic: 81032
SNP Source: dbSNP; HapMap; ABI_Val; HGBASE
Population (Allele, Count): Caucasian (T, 26|C, 94)
SNP Type: INTERGENIC; UNKNOWN Context (SEQ ID NO: 148):
TAAATTGAAACATTATGTGGCCTTTCGTGTGGGTTCTTTAACTTAGGATAGTGTTTTCAA
GTTTCATCCATATTGTAGCAAGTATCAGCACTTCATTCCAY
TTTATGGCTGGATGACATTCCAATGTATGGGTCTGCCATATTTTGTTCATGCCATTTATC
CACTCATGGATATGTAGCTTGTTTCCACTTTCTGCCCATT
Celera SNP ID: hDV70267720
Public SNP ID: rs7719425
SNP Chromosome Position: 158603516
SNP in Genomic Sequence: SEQ ID NO: 16
SNP Position Genomic: 36307
SNP Source: dbSNP; HapMap
Population (Allele, Count): Caucasian (T, 96|C, 24)
SNP Type: INTRON Context (SEQ ID NO: 149):
TCTGGAGCCAGGAGTTAGAATCCCTGAGTTCATCGTTTTCTTTCATCACTTTGTCCAGCA
AACTTAGGAGCAACCAAACAACTTTATGACATTCCTTGATY
CTCCACATATGGTCAAAGGTATTATGTATAGAGTCACTAAACTCCTTGCCTCTGCAGAG
CAGTGAATCAGGAGTATCAAATGCATTTATTTTGCATAACT
Celera SNP ID: hCV30431544
```

TABLE 2-continued

Public SNP ID: rs7715173
SNP Chromosome Position: 158597209
SNP in Genomic Sequence: SEQ ID NO: 16
SNP Position Genomic: 30000
SNP Source: dbSNP
Population (Allele, Count): Caucasian (T, 96|C, 24)
SNP Type: INTRON Context (SEQ ID NO: 150):
GTTTACAATGAGGATATTTTAGGGAAAGAATACTAATCTAGGTAGTGAATTGCCATAAG
TATAAAAACTGTTGACTTGGAAGAAAAGTGGTTATGTTGTCY
TTAATGGTTTCTGTTTAAGGCTTGGAGAGAAGTGCTTTTCTTAATATGTACTGCACCAGG
TAAAGGTACAAAAATGTATTCTTGAGTCTTGAGAAGAAAT
Celera SNP ID: hCV2084260
Public SNP ID: rs13153734
SNP Chromosome Position: 158639291
SNP in Genomic Sequence: SEQ ID NO: 16
SNP Position Genomic: 72082
Related Interrogated SNP: hCV27467945 (Power = .51)
SNP Source: dbSNP; Celera
Population (Allele, Count): Caucasian (C, 98|T, 20)
SNP Type: INTRON; PSEUDOGENE Context (SEQ ID NO: 151):
CGAAATCAGTTATTGGACTAATGATACCTATAGCAGCTCTTCAGTGTAAAAGGTAAGGA
ATGGAAAAACAGGTTGTTACAGTAAGCAACTGAAACTTATTY
TTTATTCATGGAAAGTAAAATAGTTCCTTGAGAGGAAGAGGAACTACAGGATAGGGAC
TGGGAAAAAAGGATATGCAAAAAAACGCAGATTAGTTGCATT
Celera SNP ID: hCV2084269
Public SNP ID: rs6895626
SNP Chromosome Position: 158646681
SNP in Genomic Sequence: SEQ ID NO: 16
SNP Position Genomic: 79472
SNP Source: dbSNP; Celera; HapMap
Population (Allele, Count): Caucasian (T, 26|C, 94)
SNP Type: INTERGENIC; UNKNOWN Context (SEQ ID NO: 152):
TCTGGCGAATTCTACGTGAAATGTCAGGAACCAGTGAAGGGTGTTAAGCATAGAATGA
CAATCTAATTTTTTTAACAGCCTTATTGAGATAGAATTTACM
TATCACAAATTTACCCATTTGAAGTGTGCAGTTCAATGGTTTTTAGTGTATTTAGAGAGC
TGTACAACCATCACTGTAAGCTAATTTTAGAACCTGATTT
Celera SNP ID: hCV31985611
Public SNP ID: rs13161132
SNP Chromosome Position: 158649646
SNP in Genomic Sequence: SEQ ID NO: 16
SNP Position Genomic: 82437
Related Interrogated SNP: hCV27467945 (Power = .51)
SNP Source: dbSNP; HapMap
Population (Allele, Count): Caucasian (A, 88|C, 16)
SNP Type: INTERGENIC; UNKNOWN
Gene Number: 5
Gene Symbol: hCG1979566
Gene Name:
Chromosome: 5
OMIM NUMBER:
OMIM Information:
Genomic Sequence (SEQ ID NO: 17)
SNP Information Context (SEQ ID NO: 153):
CTGTGTGCCCAGCACTTCCTCTGCATGCCTCAGATGCATTTGACAATCTCAGGTGAACTG
CACTTCAGGGTCAAGGGAACCCCGGCCATGGTTCTAAGAAR
CAACTCCCATTTTAGTATCACCTACATTTGAAACCACAGAGCACTGTCCAGGAGAGGTG
ATGGTGGTGGGTCTCCTCCTTTGGCTCTCTGGCCCATCAGC
Celera SNP ID: hCV1992693
Public SNP ID: rs1433048
SNP Chromosome Position: 158688423
SNP in Genomic Sequence: SEQ ID NO: 17
SNP Position Genomic: 27905
SNP Source: dbSNP; Celera; HapMap; ABI_Val; HGBASE
Population (Allele, Count): Caucasian (G, 21|A, 99)
SNP Type: INTRON Context (SEQ ID NO: 154):
TGGACAGATGAAGGCTGGTACTCATGCTTCTTCCCACTGCAAGAAGAGGAGCCATGTGT
CATTTCCTCTCTGTGACTGTGAGCAGCCCTTGGCCCCTGGAR
CTCCCCAGGTACAACCGGAACAACATCATGGTGCACTGGGCTTACTTTTAAGCCTAGAA
CATGAAGAGAGCTGGTTAGAAGGGGACAAGCAAAGGACTGG
Celera SNP ID: hCV1994960

TABLE 2-continued

```
Public SNP ID: rs4921483
SNP Chromosome Position: 158700943
SNP in Genomic Sequence: SEQ ID NO: 17
SNP Position Genomic: 40425
SNP Source: dbSNP; Celera; HapMap; HGBASE
Population (Allele, Count): Caucasian (A, 19|G, 99)
SNP Type: INTRON Context (SEQ ID NO: 155):
TCAAAGCAGAACCTTAGGCTCTAAGGGAAACAAGACAGAAGGATTCTGCTGACAAGAC
AGTAAAGTAGCCTGCTCATCTGGTGGTAGGCACTGTGTCAGCR
TTCTAGGTTGTAAATGTAGGAAGTAAGCAGATCAGAGGTTTGCTCAACAACCTGCCTAG
TGAGCCAAACTGCTTGCTCTTGAGGCCATGTAGTCCTTCTG
Celera SNP ID: hCV1994965
Public SNP ID: rs953861
SNP Chromosome Position: 158705160
SNP in Genomic Sequence: SEQ ID NO: 17
SNP Position Genomic: 44642
SNP Source: dbSNP; Celera; HapMap; ABI_Val
Population (Allele, Count): Caucasian (G, 20|A, 100)
SNP Type: INTRON Context (SEQ ID NO: 156):
CCTGACCTTGTGATCCTCCCGCCTCGGCCTCCCAAAGTGCTGGGATTACAGGCATGAGG
CACCGCGCCAGGCCTATTGTCTCTTTAATACCTCTCTATCAY
TTGTTGATCTCTCTTCTTAAGGAGGGCAAGCACTCTTCAGCCTTAGAGGCATTAGCAGG
CAACAGCATCTATTCTAGTGGATCTCATCCTTGGCTGCATG
Celera SNP ID: hCV1994966
Public SNP ID: rs11746138
SNP Chromosome Position: 158706357
SNP in Genomic Sequence: SEQ ID NO: 17
SNP Position Genomic: 45839
SNP Source: dbSNP; Celera; HapMap
Population (Allele, Count): Caucasian (C, 108|T, 12)
SNP Type: INTRON Context (SEQ ID NO: 157):
TCCTGTCTTCTTTAGGCCCAGTTTCCTCAACAATGAAATGGGACTAATTATCCCAGGTCA
CACTTCTCTCTGGGCTTACCCTGGGAATCAGATGATTGAGS
TTTGGTAAGTATTATTTGATAAACAAGTATGAGGAAGGAAATAAAAGGGAGATCAGTG
CTGCAGAGATGGCTAATTGGCAGATTTACACAGAACTGGATT
Celera SNP ID: hCV1994967
Public SNP ID: rs11747112
SNP Chromosome Position: 158707187
SNP in Genomic Sequence: SEQ ID NO: 17
SNP Position Genomic: 46669
SNP Source: dbSNP; Celera; HapMap
Population (Allele, Count): Caucasian (C, 108|G, 12)
SNP Type: PSEUDOGENE Context (SEQ ID NO: 158):
CTTCTTTATTTTCTCAACAATGTTTTGCAGTTCTCAGCATATAACTTTCATTTCTTTTGTTC
AATTTATTCCTAAGTATTTAATACTTTTTGGTGCTATTK
CAGATGAATTTTCCTATTAATTTTCATATTGGTCATTGCAATTGTATAAAAATACAATTA
TTTTTGTATATTGATCTTGTTTCATGCAATCTTGCTGTGA
Celera SNP ID: hCV1994971
Public SNP ID: rs7725339
SNP Chromosome Position: 158709579
SNP in Genomic Sequence: SEQ ID NO: 17
SNP Position Genomic: 49061
SNP Source: dbSNP; Celera; HapMap
Population (Allele, Count): Caucasian (G, 73|T, 35)
SNP Type: INTRON Context (SEQ ID NO: 159):
ATGAGGTGCCCTGTGGGGTTAAACAGAAATGAGAGATGCAAAGAGTGTAAGGTGGCAT
TTCCATTTCTGGTCTCTGAGCTCTACCTTTATGCACTGTTTTR
GCTGTTCAGTCTTTATCTAAATAACTTCTAATAACTCCACTGCCACCGCCATCTAGCTAT
GCTCTTGGGTAATTTGAGTTGAATTTTTGTCACATGCAAC
Celera SNP ID: hCV1994973
Public SNP ID: rs1157509
SNP Chromosome Position: 158718688
SNP in Genomic Sequence: SEQ ID NO: 17
SNP Position Genomic: 58170
SNP Source: dbSNP; Celera; HapMap; HGBASE
Population (Allele, Count): Caucasian (A, 20|G, 100)
SNP Type: INTRON
```

TABLE 2-continued

Context (SEQ ID NO: 160):
GGGGTTAAACAGAAATGAGAGATGCAAAGAGTGTAAGGTGGCATTTCCATTTCTGGTCT
CTGAGCTCTACCTTTATGCACTGTTTTAGCTGTTCAGTCTTY
ATCTAAATAACTTCTAATAACTCCACTGCCACCGCCATCTAGCTATGCTCTTGGGTAATT
TGAGTTGAATTTTTGTCACATGCAACTGAGAGTCCTGACT
Celera SNP ID: hCV1994974
Public SNP ID: rs1157510
SNP Chromosome Position: 158718702
SNP in Genomic Sequence: SEQ ID NO: 17
SNP Position Genomic: 58184
SNP Source: dbSNP; Celera; HapMap; HGBASE
Population (Allele, Count): Caucasian (T, 20|C, 100)
SNP Type: INTRON Context (SEQ ID NO: 161):
GAACAGATGACCAGGGGTGACTCAGGACAGAGCAGGTGACCAGGGGAACAGATGTGA
ACTGCTGATTAGAACTGGTGGAAAAAGTTGTTTACTGAAACTAY
GGGCGAGGAGAATGAGGAAGTTAAACTTTAAAATGGAGAACAAAGAACTGAACATACT
GACATACTGATTCTTTGAAGAGAAATTTAGAACTCACTGTAT
Celera SNP ID: hCV2084277
Public SNP ID: rs6874870
SNP Chromosome Position: 158662099
SNP in Genomic Sequence: SEQ ID NO: 17
SNP Position Genomic: 1581
SNP Source: dbSNP; Celera
Population (Allele, Count): Caucasian (T, 23|C, 93)
SNP Type: INTERGENIC; UNKNOWN Context (SEQ ID NO: 162):
CCACTTCCAACATTGGGGATCAAATTTCAACATGAGATTTGGAGGGACAAATATGCAAA
CCATATCAGGTGTTGATGGTGAAGGGGTGCTGTGTTTCTTTY
TGGGGTATTGAAAATATTCCAGAATTTATTGTGGTGATGGGAGCACAACTCTGTAAGTG
TATAAAACCTGTTGAATTAGACACCTTAAAAGAGTCACTTG
Celera SNP ID: hCV2084281
Public SNP ID: rs7730390
SNP Chromosome Position: 158663370
SNP in Genomic Sequence: SEQ ID NO: 17
SNP Position Genomic: 2852
SNP Source: dbSNP; Celera; HapMap
Population (Allele, Count): Caucasian (T, 91|C, 27)
SNP Type: INTERGENIC; UNKNOWN Context (SEQ ID NO: 163):
GTGATAATGTCTGGGCTTGGCAATTACCTTCAGTCTGTTCTCCTCCTGTGATACAGTTAA
TTTTTCCTAATTAATGAGATTCCTGGGGAGGAAACTCATGR
CAATTGAGTGCCTTTTTGGAAGATCTATCTTTAGGCAGACGAGGCAAGTTCAGAGACCA
CCCTTCCCTGTGCTTTTGAAACAGGGGTGAGAGACAGCAGG
Celera SNP ID: hCV2084283
Public SNP ID: rs1549922
SNP Chromosome Position: 158664126
SNP in Genomic Sequence: SEQ ID NO: 17
SNP Position Genomic: 3608
SNP Source: dbSNP; Celera; HapMap; ABI_Val; HGBASE
Population (Allele, Count): Caucasian (G, 63|A, 53)
SNP Type: INTERGENIC; UNKNOWN Context (SEQ ID NO: 164):
ACCAAGGCCAGGTAAAAACCACCCCTTCATCCCCTAAACCTTGCAAGAAGCACAGGGT
CCAGAATTATGCTTCTTTCAGGTTCTAAATAGCACAATAAAAY
TAATAACAATAAGCTTTTAGTTATTAGATCAGGTACATTTTACTTTACAGTAAGCTTTTA
CTTATTGGATCAGGTACATTTTAAAGCAATTTTTGAACAT
Celera SNP ID: hCV2084288
Public SNP ID: rs6870828
SNP Chromosome Position: 158671090
SNP in Genomic Sequence: SEQ ID NO: 17
SNP Position Genomic: 10572
SNP Source: dbSNP; Celera; HapMap
Population (Allele, Count): Caucasian (C, 54|T, 64)
SNP Type: INTRON Context (SEQ ID NO: 165):
AATTACTTAAATATTTAAATAGCATGAAGGCCCATGGCAACTTGAGAGCTGGAAAATCT
ATACATAAATTAGCTGATTGTTTCAATGAGCATTTAGCATCK
AACTATACAAATACAGCAAAGATATCATTGTGATCCTAAAAAAACGTTTTAAAGCAAAT
CAGATAGAAATTATCTTTTTGGGTCTATTCCGTTGTGTCTT
Celera SNP ID: hCV2084293
Public SNP ID: rs3212227
SNP Chromosome Position: 158675528
SNP in Genomic Sequence: SEQ ID NO: 17

TABLE 2-continued

```
SNP Position Genomic: 15010
SNP Source: dbSNP; Celera; HapMap; HGBASE
Population (Allele, Count): Caucasian (T, 93|G, 27)
SNP Type: UTR3; INTRON Context (SEQ ID NO: 166):
ATCAGATAGAAATTATCTTTTTGGGTCTATTCCGTTGTGTCTTTAAACATTTTGCTTAATA
TCTTCCACTTTTCCTCCAAATTTTCATCCTGGATCAGAAY
CTGGAAGAGAATGCCAAAAGTTGATGTGGGGTGACATTGTAACAGCAATGTCTCTTCTT
ATTTCTCACAACATATGATCCTGGGCAACTGGGTTTCAGGG
Celera SNP ID: hCV2084294
Public SNP ID: rs3213120
SNP Chromosome Position: 158675686
SNP in Genomic Sequence: SEQ ID NO: 17
SNP Position Genomic: 15168
SNP Source: dbSNP; Celera; HapMap; HGBASE;
Population (Allele, Count): Caucasian (C, 117|T, 3)
SNP Type: MICRORNA; UTR3; INTRON Context (SEQ ID NO: 167):
GGAAAATGTCTTAGGTTCTCTGTGTCTGTTTCCTCACTTATAAATAGGGATAACAATAAT
GCCTACTTCATAGAATTATAGTTCAAGGTAAAAATCACGTY
AAACTCTTAGCAAGTCTTTAGCACATAGGAAGCACTCAATATCACCTATTAGTCATACA
GATCTTAAATAGGGAAAGTACTTGCCAAGATGTAAAATAAT
Celera SNP ID: hCV2084295
Public SNP ID: rs2195940
SNP Chromosome Position: 158676930
SNP in Genomic Sequence: SEQ ID NO: 17
SNP Position Genomic: 16412
SNP Source: dbSNP; Celera; HapMap; HGBASE
Population (Allele, Count): Caucasian (C, 110|T, 10)
SNP Type: INTRON Context (SEQ ID NO: 168):
GGCTTTGTCCAGTGATTTTAAAAGTGGGGTGAAAGGAGTCTGGGGCGGTACAAAAGGG
CCTCTGGAACCTTGCAACAGGCAAAGGAATTCTGCTGTAAGGY
GAGGAAGCTGGGAAGCAATATCTTAGCCTCTATAAGTGTAGACATTCTGTTTAGTAAA
ATAATTTTATAATATCTGGAACAGCCAGGAGCTATCCATTT
Celera SNP ID: hCV2084296
Public SNP ID: rs2853696
SNP Chromosome Position: 158677238
SNP in Genomic Sequence: SEQ ID NO: 17
SNP Position Genomic: 16720
SNP Source: dbSNP; Celera; HapMap; ABI_Val; HGBASE
Population (Allele, Count): Caucasian (T, 26|C, 94)
SNP Type: INTRON Context (SEQ ID NO: 169):
CCCCTCTGACTCTCTCTGCAGAGAGTGTAGCAGCTCCGCACGTCACCCCTTGGGGGTCA
GAAGAGCTGAAGTCAAAGACAGAAATTAGCCTGTGTTACACM
TTGGGGAGAGAGTTCCTAGTGATTGTAGCCAGTAAGGCAGGTAAGGCCTCAACTGTTGT
CTGAGGACACAGTTTCTCCAACTGGGCTGATTTCTACCCAG
Celera SNP ID: hCV2084297
Public SNP ID: rs919766
SNP Chromosome Position: 158680142
SNP in Genomic Sequence: SEQ ID NO: 17
SNP Position Genomic: 19624
SNP Source: dbSNP; Celera; HapMap; HGBASE
Population (Allele, Count): Caucasian (A, 110|C, 10)
SNP Type: INTRON Context (SEQ ID NO: 170):
GTCTGCTTCAGGGCCCCTAAGATCTACGCCCTGGAGCTCTTGTTTTTATTTTTGACTCAA
GGTGCAATTTCAGCAAGTCATTTGTAGCTTTGAATTCTCCK
TTTATCCCTTTCTTTGGTGCTATGAGGCTTCAGGAAGCATGGCCAGGCAATTTGGATGAG
TGGGTTCAAACACAGCAGAGACTATTCTCAGTTCCCAATA
Celera SNP ID: hCV2084298
Public SNP ID: rs2853694
SNP Chromosome Position: 158681666
SNP in Genomic Sequence: SEQ ID NO: 17
SNP Position Genomic: 21148
SNP Source: dbSNP; Celera; HapMap; HGBASE
Population (Allele, Count): Caucasian (G, 65|T, 55)
SNP Type: INTRON Context (SEQ ID NO: 171):
TATCTGCCTTACATTTGACTGAGGATTAAATGAAAAAAAAAAAAAGCACGTAAAGTACT
TAGCACAGTGTCTGCCACACAGTAAATTCGGTGTTAGTTATY
GTTACTTATAGACTGAGGAGTCAGCCAACTGTACAGAGAAACTCTCTTAACAATTTTCC
ATGGATATTTAAGGATTTCGTTCCCTCTGTTTTAAATCACC
```

TABLE 2-continued

```
Celera SNP ID: hCV2084301
Public SNP ID: rs3213093
SNP Chromosome Position: 158683557
SNP in Genomic Sequence: SEQ ID NO: 17
SNP Position Genomic: 23039
SNP Source: dbSNP; Celera; HGBASE
Population (Allele, Count): Caucasian (C, 93|T, 27)
SNP Type: INTRON Context (SEQ ID NO: 172):
TTCATGGAGCCATATTTTCTGGTCATAATTGTGTATCAGGTTCATTCATGCTAATGAGAA
AGGGATTCCAGATTTTCTTTGCATCTGTCTGCTTCTCACAK
GGCTGTTAAGAAGCCACCTGCCATTCTGACAATTTCATGTCCTTAGCCATAACTACTTGT
CCTCTCTCTTGAATCTTAAGATCTTTTTGCCTTCCAGACA
Celera SNP ID: hCV7537839
Public SNP ID: rs1368439
SNP Chromosome Position: 158674592
SNP in Genomic Sequence: SEQ ID NO: 17
SNP Position Genomic: 14074
SNP Source: dbSNP; Celera; HapMap; HGBASE;
Population (Allele, Count): Caucasian (G, 26|T, 94)
SNP Type: MICRORNA; UTR3; INTRON Context (SEQ ID NO: 173):
GAAGTCCCACCAAGACTCCCAAGGATAGCGTGTTAGCATACAAGCTGAATAGCCTGTGT
TGCAGTCCCTGCTAGTCAGGGTCTTCTGGATAATGCATTGCM
TGTGTGAGGACTGGCCTGGTCCTCTGCAGGCTGAATTCTGCATTTAGCAGCTCAGTGTCC
CTTCCACGGGCCCCAGTTTCTTCATCAGGAAGGTGAGGGG
Celera SNP ID: hCV7537857
Public SNP ID: rs983825
SNP Chromosome Position: 158707543
SNP in Genomic Sequence: SEQ ID NO: 17
SNP Position Genomic: 47025
SNP Source: dbSNP; Celera; HapMap
Population (Allele, Count): Caucasian (C, 30|A, 86)
SNP Type: INTRON Context (SEQ ID NO: 174):
GCTTGTCCCAAATTTCTTTCTATTTGAACTTCCTTGGTGATAAAAATTCTCCTGTGGGAG
AATTTTTGTTGTGAACATTTTGGACATTTTGTTGTGTTTGS
CTCTAGCTAAAACATGAGCATTTGTTCCTAGAAGGGATAACATTTTTACACTTCTGTTGC
CATTAGTATGTGAGCAAGAATTAATATATGAACTCATTGT
Celera SNP ID: hCV7538743
Public SNP ID: rs1363670
SNP Chromosome Position: 158716689
SNP in Genomic Sequence: SEQ ID NO: 17
SNP Position Genomic: 56171
SNP Source: dbSNP; HapMap; ABI_Val; HGBASE
Population (Allele, Count): Caucasian (G, 20|C, 100)
SNP Type: INTRON Context (SEQ ID NO: 175):
GGAGAGCAGGAGCAGGAGCTGGGGTGATTGCCTTTGGAAGCCATTAGGAACAAACTGT
GTACCAGCCTGTGGCAGTGTCTAGGGGTTGTCCATGACCTCTR
GAGCCCAAGGGGGCATGTGTTACAAACAATACTCTTTTAGCATTTGCTGTCCACAGACA
GCTAAGTGTTTACCCGCTCAGTGGAGGGTTGGGGTGACAGC
Celera SNP ID: hCV11269323
Public SNP ID: rs11135059
SNP Chromosome Position: 158703915
SNP in Genomic Sequence: SEQ ID NO: 17
SNP Position Genomic: 43397
SNP Source: dbSNP; Celera; HapMap
Population (Allele, Count): Caucasian (G, 81|A, 39)
SNP Type: INTRON Context (SEQ ID NO: 176):
GGACAGTAGAGGTGCTTTCCTGTGGGATCCCCAATCTCTCCCCGCCTTCAGGTGAGTCC
TGCTGATGCTCAGGCTGCCCTTGGAACAGGGACCTTGGCCAY
AGTTTCCTTATCTGTAATAATGGGATGAGAATTCCTCCTGCACAGGGTTGTTAGGGACCT
CGTGAGGCAGCTTCTATGGCTGCCTTTGGTGCTTAGTTTT
Celera SNP ID: hCV11316602
Public SNP ID: rs1865014
SNP Chromosome Position: 158671666
SNP in Genomic Sequence: SEQ ID NO: 17
SNP Position Genomic: 11148
SNP Source: dbSNP; HapMap
Population (Allele, Count): Caucasian (T, 20|C, 94)
SNP Type: INTRON
```

TABLE 2-continued

```
Context (SEQ ID NO: 177):
TTAATGGTTATGGGCCATGCATTGAAGGACCACCCTGTCTGTGCTAATCCCTCACTTTGC
ACTGAACATGGAACTAAGCTGAGCCTCTCCCTGGGGATGAR
ATGATAGATTTTCTATTTACTGCCCTTTCTTTTGTCTTTTCATAGCTTTTGGTGCGGACAT
GTCTTGGAGCAGTTACAGTCAATTGTCTCTATGCTCAAT
Celera SNP ID: hCV15803290
Public SNP ID: rs2421047
SNP Chromosome Position: 158678885
SNP in Genomic Sequence: SEQ ID NO: 17
SNP Position Genomic: 18367
SNP Source: dbSNP; Celera; HapMap; HGBASE
Population (Allele, Count): Caucasian (G, 93|A, 27)
SNP Type: TRANSCRIPTION FACTOR BINDING SITE; INTRON Context (SEQ ID NO: 178):
GCTCATTTGCTGTTGAGCAGTGGGAGCAACTTGTTGGCCAAGTTACTCGCTGAGCCTCA
GTCTCTTTGTCTATAAAATGGACCTAATACTTATCTCAAAGR
CTTGTTGGGAAAGGCAATGAGATAACATATTATAGAAGGCAACCAATAACATATTAACT
TGAACCTAGAGGAAGAGGTAAGGGAACAATTCGGTATCTGT
Celera SNP ID: hCV15894459
Public SNP ID: rs2546892
SNP Chromosome Position: 158688053
SNP in Genomic Sequence: SEQ ID NO: 17
SNP Position Genomic: 27535
SNP Source: dbSNP; HapMap; HGBASE
Population (Allele, Count): Caucasian (G, 103|A, 17)
SNP Type: INTRON Context (SEQ ID NO: 179):
GAGAAACTTCCAGCACAATTTCAGTTTCATAGAGAATACGGCAGGGCACAATATTCAGC
AGAGTAACATAGTGGTTAAAAGCTCAGGGTGTCGAGAACAAY
GAACCAAGACTGTCATCCTGTCTCCACTAACCAGCTGGGGGATTTGGAACAAGGTATTT
CATTATCATGAGCCTCAGTTTCCTCATCTGTAAAATGATAA
Celera SNP ID: hCV29927086
Public SNP ID: rs3213094
SNP Chromosome Position: 158683347
SNP in Genomic Sequence: SEQ ID NO: 17
SNP Position Genomic: 22829
SNP Source: dbSNP; HapMap; HGBASE
Population (Allele, Count): Caucasian (C, 93|T, 27)
SNP Type: TRANSCRIPTION FACTOR BINDING SITE; INTRON Context (SEQ ID NO: 180):
CTCACCTAACTGCAGGGCACAGATGCCCATTCGCTCCAAGATGAGCTATAGTAGCGGTC
CTGGGCCCGCACGCTAATGCTGGCATTTTTGCGGCAGATGAM
CGTGGCTGAGGTCTTGTCCGTGAAGACTCTATCTTTCTGCAAAAGAGAAGGAAAGCTGT
GAAGACCCCTTGGCAACATAGTCACAGGGTAAGCTGAGCCT
Celera SNP ID: hCV31985602
Public SNP ID: rs3213119
SNP Chromosome Position: 158676366
SNP in Genomic Sequence: SEQ ID NO: 17
SNP Position Genomic: 15848
SNP Source: dbSNP; HapMap; HGBASE;
Population (Allele, Count): Caucasian (C, 115|A, 1)
SNP Type: MISSENSE MUTATION; INTRON Context (SEQ ID NO: 181):
AACAAGGGGCTTCTTGAGAGGAAATGAAAGGAGACGGAGATGCGGTTTTGCCTTAAGG
TTTTTAATGTGAGCCACTGAGAAGATTCATTTTGAAATAGAAR
GATGTGTCTGACAGTGTGATGTAAATGCAGGCATTTTGGAGTCCCTGCTGGAGAACACA
CAGAGGTGAGTAGGGGTTCTCCAGTGACCTTGTGGGAGTCT
Celera SNP ID: hCV27106385
Public SNP ID: rs4244437
SNP Chromosome Position: 158705695
SNP in Genomic Sequence: SEQ ID NO: 17
SNP Position Genomic: 45177
SNP Source: dbSNP; Celera; HapMap; HGBASE
Population (Allele, Count): Caucasian (G, 31|A, 87)
SNP Type: INTRON Context (SEQ ID NO: 182):
CCTGGGCCCGCACGCTAATGCTGGCATTTTTGCGGCAGATGACCGTGGCTGAGGTCTTG
TCCGTGAAGACTCTATCTTTCTGCAAAAGAGAAGGAAAGCTR
TGAAGACCCCTTGGCAACATAGTCACAGGGTAAGCTGAGCCTGTTTCTGCAATGCATAC
TCTCCCAAAACAAGCCCATCTTGGTCTTAGGGCACTGTGCT
Celera SNP ID: hCV27106395
Public SNP ID: rs11574790
SNP Chromosome Position: 158676424
SNP in Genomic Sequence: SEQ ID NO: 17
```

TABLE 2-continued

```
SNP Position Genomic: 15906
SNP Source: dbSNP; Celera; HapMap;
Population (Allele, Count): Caucasian (G, 110|A, 10)
SNP Type: INTRON Context (SEQ ID NO: 183):
TAAAAATCTGGTTAGTGTTGTTCATTAAATGTCCGTTAAGTACTTTGGTAACTGCAGATG
AAAGACCCTGTAGGGGACAAACACTTGTTATTAACAACCR
TATGCTGTCAAGTGTGGGCTTATAACACGGGACCATATGCTCCAAAGGTTGGCAAAGAA
TGACAGAAGCCACCCACCATTCCTCCAGGCCAGGAGCAGAG
Celera SNP ID: hCV27467944
Public SNP ID: rs3181224
SNP Chromosome Position: 158673428
SNP in Genomic Sequence: SEQ ID NO: 17
SNP Position Genomic: 12910
SNP Source: dbSNP; HapMap; HGBASE
Population (Allele, Count): Caucasian (A, 110|G, 10)
SNP Type: INTRON Context (SEQ ID NO: 184):
GTAGTGGCTAGATTTACAATAAAAAGGACAGTCCTGGAGACTATCTTTAAAGAAGAAA
AACTCTGCATTGCATGCACTGAAATTAATCGAATGCTAAGAGR
TCATGTCGCAAAAGCACTGGGCATGGTGGGAGCCAGAACATCTCACCTCTGCCCCAGGC
TGGCCAGAAATTTGGGGAAAGGTCCCAGTTCTCAGTGCTTA
Celera SNP ID: hCV27467945
Public SNP ID: rs3181225
SNP Chromosome Position: 158673201
SNP in Genomic Sequence: SEQ ID NO: 17
SNP Position Genomic: 12683
SNP Source: dbSNP; HapMap; HGBASE
Population (Allele, Count): Caucasian (G, 102|A, 18)
SNP Type: INTRON Context (SEQ ID NO: 185):
GCAATGCTCAACTGTTTCAGTCAAATACCTTAAAAATGAGCATTCCTGGGTTGGGTGAC
GGAATATTGACAAATTACAGCTTTGTCAGAACTGCTACTAAS
TCTAGGCGGACCTTGCTATGTACTTTATTCCCTTATAAAGTTTGTGAGTGGCAGAGACAG
GCCTAGAAGTCAAGCCTTCTTGGACACTGCTCAGTGCTGT
Celera SNP ID: hCV27471935
Public SNP ID: rs3212217
SNP Chromosome Position: 158687708
SNP in Genomic Sequence: SEQ ID NO: 17
SNP Position Genomic: 27190
SNP Source: dbSNP; HapMap; HGBASE
Population (Allele, Count): Caucasian (G, 93|C, 27)
SNP Type: INTRON Context (SEQ ID NO: 186):
TGTGTGCTGGAGCACCCAGAACTGAAGGACTTGGGTTAGGGACAGGAACGGTAATACA
GAGGCGAACTTTCAGGTTCTGGCAACGACCTGGTCACCAGCCM
TTGCTGTAGGGGTTTAGCTTCTCTTGTTTTCCAAGTTCAAAGACTACTCTCTCCCATATA
GAGAACCTAGTGGTTCTAAAATTTGAGTGACTGTCAGGAT
Celera SNP ID: hCV27486507
Public SNP ID: rs3212219
SNP Chromosome Position: 158687039
SNP in Genomic Sequence: SEQ ID NO: 17
SNP Position Genomic: 26521
SNP Source: dbSNP; HGBASE
Population (Allele, Count): Caucasian (C, 89|A, 27)
SNP Type: INTRON Context (SEQ ID NO: 187):
GTTCAAAGACTACTCTCTCCCATATAGAGAACCTAGTGGTTCTAAAATTTGAGTGACTG
TCAGGATAACCTGGAAGCACTGCTACAACAGACGGCTGAGTM
CCACCCCCAGAGTGTCTGATTCAGCAGGCATGAGGGCCTGAGAATATGCATTTCTAGAA
AGTTTCCAGGGGAAGCAGATGCTGCTGGCGCTAAGACCACA
Celera SNP ID: hCV27508808
Public SNP ID: rs3212218
SNP Chromosome Position: 158687174
SNP in Genomic Sequence: SEQ ID NO: 17
SNP Position Genomic: 26656
SNP Source: dbSNP; HapMap; HGBASE
Population (Allele, Count): Caucasian (C, 81|A, 25)
SNP Type: INTRON Context (SEQ ID NO: 188):
AATGAACAGAAAATGGAAGTGAGGTACAGAGACAGCTTGGTTGGTTACAGCTAGGTGT
TTGCTTTATTTGAGCATGGTCTGATCAGTTGGTAACCTATAAY
TGATTGGAGGTTTGCTGCTGTGTTTTACTGCTGAGGCTCAGCTATTAGCTACAAAAATAT
ATTAAATTAGCTTTCAGTCAGTTCATACCAAGTTAGGTTG
```

TABLE 2-continued

```
Celera SNP ID: hCV28001193
Public SNP ID: rs4921466
SNP Chromosome Position: 158665350
SNP in Genomic Sequence: SEQ ID NO: 17
SNP Position Genomic: 4832
SNP Source: dbSNP; HGBASE
Population (Allele, Count): Caucasian (T, 112|C, 8)
SNP Type: INTERGENIC; UNKNOWN Context (SEQ ID NO: 189):
AGTTGGATTCCCCAAAATAATTAGTTAGTTAATTTGTTGACTGATTGATTGACACATTGC
TAGCTCCTCTCAGACTGCCCAGTCTTCCTCATGCCCAAAGK
GCTCTCATTCTGTTCATGATAACGCCCAAAATCTTTACCTTGGCACACTCGTTTCTCCAT
GATCTGCCCCTACTCCCTAATCGCTGTCACCTCCTACAAT
Celera SNP ID: hCV29349406
Public SNP ID: rs6556411
SNP Chromosome Position: 158715801
SNP in Genomic Sequence: SEQ ID NO: 17
SNP Position Genomic: 55283
SNP Source: dbSNP; HapMap
Population (Allele, Count): Caucasian (G, 32|T, 88)
SNP Type: INTRON Context (SEQ ID NO: 190):
CTGTATGCCCAGCAAAGGGCTGGTGGCTGGAAGGACATAGCTTTCTGAGTTAGGACTGG
AAGGCTTCTGTACATGTCCAAAGTCAACCTTCATATTCATGR
GGAGGGAAAAAGAAGTGGGCTTTAGGATTGCCTCTCCTTGTTGGCCTGCTCTGAGAAAA
ACAATCGCGGGAGGGTGAGGCGGGAGAATCGCTTGAGCCCA
Celera SNP ID: hCV29349409
Public SNP ID: rs6859018
SNP Chromosome Position: 158669570
SNP in Genomic Sequence: SEQ ID NO: 17
SNP Position Genomic: 9052
SNP Source: dbSNP
Population (Allele, Count): Caucasian (G, 91|A, 27)
SNP Type: INTERGENIC; UNKNOWN Context (SEQ ID NO: 191):
CTCTTATTTTTAAGATGAGAAACTTAAAGCTTAGAGAAGGAATGTGACTTTCTGGATCA
ACATCTAGCAGTTGTTTATTTAGTGCTTACTACATAAAGAGM
ACTGGGCTAGAAGCAGTTGAGAGAGAAAAAAAGGGCTTACCTGGATCCCGCTTCCTAG
GAGCAAATACTTTTACTCAATAAATATTTATTAAGTCAGTGT
Celera SNP ID: hCV30449508
Public SNP ID: rs3212220
SNP Chromosome Position: 158686773
SNP in Genomic Sequence: SEQ ID NO: 17
SNP Position Genomic: 26255
SNP Source: dbSNP; HapMap; ABI_Val; HGBASE
Population (Allele, Count): Caucasian (C, 93|A, 27)
SNP Type: INTRON Context (SEQ ID NO: 192):
TACTACAGGGGAGAACACTGGTGGACAGACACAACCTAAACAAAGTGATCAAAGTTAA
TTTCACCAGTACTGAGAGACATTGATTTCATGCCCCTCCTGAY
GAGATTCACTGAGAAGGGCACAGTATTACTGCTGTAGGATGCTTGACAAAAATGTAGA
ACCCAAATTTAATCATGAAGAAACATGAGACAAATGTCACTT
Celera SNP ID: hCV29619986
Public SNP ID: rs10072923
SNP Chromosome Position: 158668354
SNP in Genomic Sequence: SEQ ID NO: 17
SNP Position Genomic: 7836
SNP Source: dbSNP; HapMap
Population (Allele, Count): Caucasian (T, 93|C, 27)
SNP Type: INTERGENIC; UNKNOWN Context (SEQ ID NO: 193):
TAAATAAAATAAAATAAAGTAGAAAAGAAACAAAAATTATAAGATAGGGACATTAAAT
GGAGTTAGAAATGAGGCTAATAAATAATGAATATGCTGCACCR
TGGAATACTACTCAGCCATAAAACAGAACAAAATAATGGACTTTGCAGCAACTTGGAT
GGAGCTGGAAGCCATTATCTTAAGTGAAATAATTCACAAATG
Celera SNP ID: hCV31985582
Public SNP ID: rs6556412
SNP Chromosome Position: 158719963
SNP in Genomic Sequence: SEQ ID NO: 17
SNP Position Genomic: 59445
SNP Source: dbSNP; HapMap
Population (Allele, Count): Caucasian (G, 79|A, 39)
SNP Type: INTRON
```

TABLE 2-continued

```
Context (SEQ ID NO: 194):
CATTCTCATTTAAATTTGTATATCCCTGATTATTTTTGAGGCCAGGCACCTTCTCAGTCTA
TCAGTTATCTGTTAAGTTTTGAATCGATTTGTCCATTGGY
TGTCTTACCTTATTGATTGGTAGAAGCCCTTAATTTTGGCATGAGCTCTTTATTAGTTAC
ATGTGTGGCAAATATTTTCTCCCACTCAGGGACTTGCTGT
Celera SNP ID: hCV30611467
Public SNP ID: rs6869411
SNP Chromosome Position: 158714182
SNP in Genomic Sequence: SEQ ID NO: 17
SNP Position Genomic: 53664
SNP Source: dbSNP; HapMap; ABI_Val
Population (Allele, Count): Caucasian (T, 71|C, 49)
SNP Type: INTRON Context (SEQ ID NO: 195):
ATAGCTTTTCATTTTTTAACTGGGGCCAAAGTTAGTTAATCCACAAGAATGGGGATCCC
AGCTGTCATTTTGGTTGATATCACAACTGACGACCAAGACCR
TCACAAATATGGGAGCAAGTCTGATTTGTAACATTATTATAATTATGAATCCAATTACTT
TAAGGAATGCACGAAAGGCTTTTTAAAAATTTCAATAGTA
Celera SNP ID: hDV71045748
Public SNP ID: rs6894567
SNP Chromosome Position: 158689546
SNP in Genomic Sequence: SEQ ID NO: 17
SNP Position Genomic: 29028
SNP Source: dbSNP; HapMap
Population (Allele, Count): Caucasian (A, 94|G, 26)
SNP Type: INTRON Context (SEQ ID NO: 196):
ACAGACCTAGTTAGACCATAGTCCATATTTCAAATATAATTACATGTGCTCATAGCTGA
GAACCTTCTCCTGGGATGGATGCATTTCACCAGGTCACTGCY
GAAATGTTGTACTTTTATGGATGGTGATGAGGAAGCATCTGTTTTAGGTGTGGTATTTCC
TGGAGGCAGAAAACTGCTTGAGTTAGCTCATTCAGTTTTT
Celera SNP ID: hCV31985592
Public SNP ID: rs7709212
SNP Chromosome Position: 158696755
SNP in Genomic Sequence: SEQ ID NO: 17
SNP Position Genomic: 36237
SNP Source: dbSNP; HapMap; ABI_Val
Population (Allele, Count): Caucasian (T, 76|C, 44)
SNP Type: INTRON Context (SEQ ID NO: 197):
AAAACATATGGGTTGGGTTATCCACTTCAATGACTGCACATTAAGCAAGAGTATAGTGT
ACCATGTTTTATTTAACCATTCCTCTGCTGATTATGTCTTTW
TGCACTTGGAGAAACATTTCTTTAGTAAGCATTTTCCTTTTAAAGATGAAAAAGTGAGA
CCCCAATGCTTAATTTACTCAGTGAAATAATGGTAAAGTCA
Celera SNP ID: hDV75439995
Public SNP ID: rs3213097
SNP Chromosome Position: 158681257
SNP in Genomic Sequence: SEQ ID NO: 17
SNP Position Genomic: 20739
SNP Source: CDX; dbSNP
Population (Allele, Count): Caucasian (T, 89|A, 27)
SNP Type: INTRON Context (SEQ ID NO: 198):
GTGATTCAGATCTGGGATGGGGCTCAGGAACCTGCATTTTAACAATGGAGGTTCTAATG
TGGTCATTGGCAGGTTGTTCTAATGTGGGGGCCACATTAGAG
/TTAGA
CCTCTCTCGGAGACAGGCTGTACATGGCCAGCCAGCATTCTGGTAATATGAGCCAAATG
CCCATTGACCTAATTTTGGAGAAGAGGTTTATCAACATGTC
Celera SNP ID: hDV79877074
Public SNP ID: rs17860508
SNP Chromosome Position: 158692783
SNP in Genomic Sequence: SEQ ID NO: 17
SNP Position Genomic: 32265
SNP Source: dbSNP
Population (Allele, Count): no_pop (G, —|, —)
SNP Type: INTRONIC INDEL Context (SEQ ID NO: 199):
CCATATCAGGTGTTGATGGTGAAGGGGTGCTGTGTTTCTTTTTGGGGTATTGAAAATATT
CCAGAATTTATTGTGGTGATGGGAGCACAACTCTGTAAGTS
TATAAAACCTGTTGAATTAGACACCTTAAAAGAGTCACTTGTAGAGTATGTGAACTATA
CCTCATTACAGCTGTTAGAAAAATGTATACCTTGGTGGTCA
Celera SNP ID: hCV2084282
Public SNP ID: rs2099327
SNP Chromosome Position: 158663429
```

TABLE 2-continued

```
SNP in Genomic Sequence: SEQ ID NO: 17
SNP Position Genomic: 2911
Related Interrogated SNP: hCV27467945 (Power = .51)
SNP Source: dbSNP; Celera; HGBASE
Population (Allele, Count): Caucasian (G, 100|C, 20)
SNP Type: INTERGENIC; UNKNOWN Context (SEQ ID NO: 200):
AATATCTGATTGTGTTACTTCCTTGCTGAAAACCCTTCAGTGGGTTTCAGGGCCCGGGGC
CCCCAGAACAAGATTCTGAGTCCTGCAAGCTTGCAAGTCCK
CCATGCTCTGCCTCCTGGCTACCTCTCTCTTTTCTTTGCCTTTCTCTTTAGGAGGCCAGAA
CCCCGGTCTGTTTTCTTTCCTGCAATATCCCTGTGGCCA
Celera SNP ID: hCV15824051
Public SNP ID: rs2853697
SNP Chromosome Position: 158675981
SNP in Genomic Sequence: SEQ ID NO: 17
SNP Position Genomic: 15463
Related Interrogated SNP: hCV15894459 (Power = .51)
Related Interrogated SNP: hCV27467945 (Power = .51)
SNP Source: dbSNP; HapMap; HGBASE
Population (Allele, Count): Caucasian (T, 102|G, 18)
SNP Type: TRANSCRIPTION FACTOR BINDING SITE; INTRON Context (SEQ ID NO: 201):
TGGAGGTTAACATCAATTAACATCAATAAGAGACTTGATGTTAATTCATTACACTCACC
ATGACTTGGCTTTTCAATTTGTTGTTGTTGTTGTTTTTAACY
CTTATGAGCGAAAGAGAAAATTGATACTATCCAAGGGTATAGAATTACCTTTCTGGTCC
TTTAAAATATCAGTGGACCAAATTCCATCTTCCTTTTTGTG
Celera SNP ID: hCV15879826
Public SNP ID: rs2288831
SNP Chromosome Position: 158682591
SNP in Genomic Sequence: SEQ ID NO: 17
SNP Position Genomic: 22073
Related Interrogated SNP: hCV2084270 (Power = .51)
Related Interrogated SNP: hCV2084293 (Power = .51)
Related Interrogated SNP: hDV71045748 (Power = .51)
SNP Source: dbSNP; HapMap; ABI_Val; HGBASE
Population (Allele, Count): Caucasian (T, 91|C, 25)
SNP Type: TRANSCRIPTION FACTOR BINDING SITE; INTRON Context (SEQ ID NO: 202):
TGAAGCAGTCCAGTAGAGCTTAGTCTTCCCATTTAATGAAGAAGCGTACTGAGGCCAAC
GATCTAAGCATGGTCACAGCAAGTCAGAAGTACAAGGGCTAY
AGCTCAGACCTTTTGTCTCTTGGGCTTTGCAAGGGATGCCTAATGCTAGTGTCTAAACTG
GCCTTTGAGGAATGGCTTAGTATAGTATTTCAGAGTGTGT
Celera SNP ID: hCV16044033
Public SNP ID: rs2569254
SNP Chromosome Position: 158683827
SNP in Genomic Sequence: SEQ ID NO: 17
SNP Position Genomic: 23309
Related Interrogated SNP: hCV27467945 (Power = .51)
SNP Source: dbSNP; HapMap; HGBASE
Population (Allele, Count): Caucasian (C, 102|T, 18)
SNP Type: INTRON Context (SEQ ID NO: 203):
TCACAAGTCTGTTATGTAACCATAGTTGGGACTGGAGTCTGCTCCTCTGATTCCCAGTCC
TAAGATCTTTGGCTTAGACATTTAGTACATTTTGTAGTGGS
TAGATTTACAATAAAAAGGACAGTCCTGGAGACTATCTTTAAAGAAGAAAAACTCTGC
ATTGCATGCACTGAAATTAATCGAATGCTAAGAGGTCATGTC
Celera SNP ID: hCV27467946
Public SNP ID: rs3181226
SNP Chromosome Position: 158673108
SNP in Genomic Sequence: SEQ ID NO: 17
SNP Position Genomic: 12590
Related Interrogated SNP: hCV15894459 (Power = .51)
Related Interrogated SNP: hCV27467945 (Power = .51)
SNP Source: dbSNP; HapMap; ABI_Val; HGBASE
Population (Allele, Count): Caucasian (G, 102|C, 18)
SNP Type: INTRON Context (SEQ ID NO: 204):
TTATGTCTTTATGCACTTGGAGAAACATTTCTTTAGTAAGCATTTTCCTTTTAAAGATGA
AAAAGTGAGACCCCAATGCTTAATTTACTCAGTGAAATAAW
GGTAAAGTCAGGATGATCACCTGGGGTTTGCTTCGGTGATGATTAAAGTAAGCCACATG
GGGGTTAACACATAGGTCTTGTATTTATGGAAGTTGCTTTC
Celera SNP ID: hCV32389155
Public SNP ID:
SNP Chromosome Position: 158681347
SNP in Genomic Sequence: SEQ ID NO: 17
```

TABLE 2-continued

```
SNP Position Genomic: 20829
SNP Source: HGBASE; dbSNP
Population (Allele, Count): no_pop (A, -|T, -)
SNP Type: INTRON Context (SEQ ID NO: 205):
TACCTCCCAACAGTCCTGTGAATTTACTATGCTACCCCAGGGTGACCTGGTAGAGAGTT
TGGAACCACAGCTAGCCATAGTACTTTCAAACTACTAAAGTY
AGATATCTCTTTGCCACCAAATCCCTCCTCAGGGCCATATGTGACCCTGCATTTTGTGCA
GGGATTCCAGGAAGCAAAGTTGTCACTCTTTCTGGAAACT
Celera SNP ID: hCV31985590
Public SNP ID: rs11738529
SNP Chromosome Position: 158702844
SNP in Genomic Sequence: SEQ ID NO: 17
SNP Position Genomic: 42326
Related Interrogated SNP: hCV30611467 (Power = .51)
SNP Source: dbSNP; HapMap
Population (Allele, Count): Caucasian (T, 64|C, 46)
SNP Type: INTRON Context (SEQ ID NO: 206):
AGTGACAATTACATATCAGGCACCCAGCTAAATTCTGTGAATGTAGTAAGCAGATCAGA
CCTGGACTCTGTCCTCATAGAGCTAAATAGATATGTGCAGAR
GACAAAATGCTATGAAGGAAATGAATGGGTGGTGAGACAGAGAATCACAGGGGAGGG
CTCTCTGATGAGGTGGCATTTAAGTTGGGACCTACAGGTGAAC
Celera SNP ID: hDV70836316
Public SNP ID: rs17056705
SNP Chromosome Position: 158701831
SNP in Genomic Sequence: SEQ ID NO: 17
SNP Position Genomic: 41313
Related Interrogated SNP: hCV11314640 (Power = .51)
SNP Source: dbSNP; HapMap
Population (Allele, Count): Caucasian (G, 112|A, 8)
SNP Type: INTRON Context (SEQ ID NO: 207):
CCTGCCAGAAGGCAATTAAAGAGTGGAAGAGCAGAAATGCAGAGAAGGAATTCAACA
CCTGCTCCACCAGCACGTTCCTTGGTCGCTCTCGTCTGTTTCCY
TAGCTGGATCACATTCTTGGTGAATGAGAGAAAGTATGAGGATTAATGAGCAGACCTGT
CTTTGGGATACCCTAGAACCATGATGCAATGCAAATATCAC
Celera SNP ID: hDV70836317
Public SNP ID: rs17056706
SNP Chromosome Position: 158703333
SNP in Genomic Sequence: SEQ ID NO: 17
SNP Position Genomic: 42815
Related Interrogated SNP: hCV30611467 (Power = .51)
SNP Source: dbSNP; HapMap
Population (Allele, Count): Caucasian (C, 69|T, 49)
SNP Type: INTRON Context (SEQ ID NO: 208):
GGATGAGTCTCACTTAGTCATGAAATGCAGTCTCTTTGTATGTTGCTGGATTTAGTTTGC
TAGTACTTTGTTGAGAATTTGTGCCTCCATATTCTTAAGTR
ATTTTGGTCTGCAGTTTTTTTTTTGAGATGTGTTTGTCTGGTTTTGATATCAGGGTAATAC
TAATTTCATAGAATAAGTTAAGAAGTGTTTCCTCCTCTT
Celera SNP ID: hCV31985588
Public SNP ID: rs6878967
SNP Chromosome Position: 158711610
SNP in Genomic Sequence: SEQ ID NO: 17
SNP Position Genomic: 51092
Related Interrogated SNP: hCV30611467 (Power = .51)
SNP Source: dbSNP; HapMap; ABI_Val
Population (Allele, Count): Caucasian (A, 71|G, 49)
SNP Type: INTRON
Gene Number: 6
Gene Symbol: hCG2038173
Gene Name:
Chromosome: 5
OMIM NUMBER:
OMIM Information:
Genomic Sequence (SEQ ID NO: 18)
SNP Information Context (SEQ ID NO: 209):
CTGTGTGCCCAGCACTTCCTCTGCATGCCTCAGATGCATTTGACAATCTCAGGTGAACTG
CACTTCAGGGTCAAGGGAACCCCGGCCATGGTTCTAAGAAR
CAACTCCCATTTTAGTATCACCTACATTTGAAACCACAGAGCACTGTCCAGGAGAGGTG
ATGGTGGTGGGTCTCCTCCTTTGGCTCTCTGGCCCATCAGC
Celera SNP ID: hCV1992693
Public SNP ID: rs1433048
```

TABLE 2-continued

```
SNP Chromosome Position: 158688423
SNP in Genomic Sequence: SEQ ID NO: 18
SNP Position Genomic: 15090
SNP Source: dbSNP; Celera; HapMap; ABI_Val; HGBASE
Population (Allele, Count): Caucasian (G, 21|A, 99)
SNP Type: INTRON Context (SEQ ID NO: 210):
TGGACAGATGAAGGCTGGTACTCATGCTTCTTCCCACTGCAAGAAGAGGAGCCATGTGT
CATTTCCTCTCTGTGACTGTGAGCAGCCCTTGGCCCCTGGAR
CTCCCCAGGTACAACCGGAACAACATCATGGTGCACTGGGCTTACTTTTAAGCCTAGAA
CATGAAGAGAGCTGGTTAGAAGGGGACAAGCAAAGGACTGG
Celera SNP ID: hCV1994960
Public SNP ID: rs4921483
SNP Chromosome Position: 158700943
SNP in Genomic Sequence: SEQ ID NO: 18
SNP Position Genomic: 27610
SNP Source: dbSNP; Celera; HapMap; HGBASE
Population (Allele, Count): Caucasian (A, 19|G, 99)
SNP Type: INTRON Context (SEQ ID NO: 211):
TCAAAGCAGAACCTTAGGCTCTAAGGGAAACAAGACAGAAGGATTCTGCTGACAAGAC
AGTAAAGTAGCCTGCTCATCTGGTGGTAGGCACTGTGTCAGCR
TTCTAGGTTGTAAATGTAGGAAGTAAGCAGATCAGAGGTTTGCTCAACAACCTGCCTAG
TGAGCCAAACTGCTTGCTCTTGAGGCCATGTAGTCCTTCTG
Celera SNP ID: hCV1994965
Public SNP ID: rs953861
SNP Chromosome Position: 158705160
SNP in Genomic Sequence: SEQ ID NO: 18
SNP Position Genomic: 31827
SNP Source: dbSNP; Celera; HapMap; ABI_Val
Population (Allele, Count): Caucasian (G, 20|A, 100)
SNP Type: INTRON Context (SEQ ID NO: 212):
CCTGACCTTGTGATCCTCCCGCCTCGGCCTCCCAAAGTGCTGGGATTACAGGCATGAGG
CACCGCGCCAGGCCTATTGTCTCTTTAATACCTCTCTATCAY
TTGTTGATCTCTCTTCTTAAGGAGGGCAAGCACTCTTCAGCCTTAGAGGCATTAGCAGG
CAACAGCATCTATTCTAGTGGATCTCATCCTTGGCTGCATG
Celera SNP ID: hCV1994966
Public SNP ID: rs11746138
SNP Chromosome Position: 158706357
SNP in Genomic Sequence: SEQ ID NO: 18
SNP Position Genomic: 33024
SNP Source: dbSNP; Celera; HapMap
Population (Allele, Count): Caucasian (C, 108|T, 12)
SNP Type: INTRON Context (SEQ ID NO: 213):
TCCTGTCTTCTTTAGGCCCAGTTTCCTCAACAATGAAATGGGACTAATTATCCCAGGTCA
CACTTCTCTCTGGGCTTACCCTGGGAATCAGATGATTGAGS
TTTGGTAAGTATTATTTGATAAACAAGTATGAGGAAGGAAATAAAAGGGAGATCAGTG
CTGCAGAGATGGCTAATTGGCAGATTTACACAGAACTGGATT
Celera SNP ID: hCV1994967
Public SNP ID: rs11747112
SNP Chromosome Position: 158707187
SNP in Genomic Sequence: SEQ ID NO: 18
SNP Position Genomic: 33854
SNP Source: dbSNP; Celera; HapMap
Population (Allele, Count): Caucasian (C, 108|G, 12)
SNP Type: PSEUDOGENE Context (SEQ ID NO: 214):
CTTCTTTATTTTCTCAACAATGTTTTGCAGTTCTCAGCATATAACTTTCATTTCTTTTGTTC
AATTTATTCCTAAGTATTTAATACTTTTTGGTGCTATTK
CAGATGAATTTTCCTATTAATTTTCATATTGGTCATTGCAATTGTATAAAAATACAATTA
TTTTTGTATATTGATCTTGTTTCATGCAATCTTGCTGTGA
Celera SNP ID: hCV1994971
Public SNP ID: rs7725339
SNP Chromosome Position: 158709579
SNP in Genomic Sequence: SEQ ID NO: 18
SNP Position Genomic: 36246
SNP Source: dbSNP; Celera; HapMap
Population (Allele, Count): Caucasian (G, 73|T, 35)
SNP Type: INTRON Context (SEQ ID NO: 215):
ATGAGGTGCCCTGTGGGGTTAAACAGAAATGAGAGATGCAAAGAGTGTAAGGTGGCAT
TTCCATTTCTGGTCTCTGAGCTCTACCTTTATGCACTGTTTTR
```

TABLE 2-continued

```
GCTGTTCAGTCTTTATCTAAATAACTTCTAATAACTCCACTGCCACCGCCATCTAGCTAT
GCTCTTGGGTAATTTGAGTTGAATTTTTGTCACATGCAAC
Celera SNP ID: hCV1994973
Public SNP ID: rs1157509
SNP Chromosome Position: 158718688
SNP in Genomic Sequence: SEQ ID NO: 18
SNP Position Genomic: 45355
SNP Source: dbSNP; Celera; HapMap; HGBASE
Population (Allele, Count): Caucasian (A, 20|G, 100)
SNP Type: INTRON Context (SEQ ID NO: 216):
GGGGTTAAACAGAAATGAGAGATGCAAAGAGTGTAAGGTGGCATTTCCATTTCTGGTCT
CTGAGCTCTACCTTTATGCACTGTTTTAGCTGTTCAGTCTTY
ATCTAAATAACTTCTAATAACTCCACTGCCACCGCCATCTAGCTATGCTCTTGGGTAATT
TGAGTTGAATTTTTGTCACATGCAACTGAGAGTCCTGACT
Celera SNP ID: hCV1994974
Public SNP ID: rs1157510
SNP Chromosome Position: 158718702
SNP in Genomic Sequence: SEQ ID NO: 18
SNP Position Genomic: 45369
SNP Source: dbSNP; Celera; HapMap; HGBASE
Population (Allele, Count): Caucasian (T, 20|C, 100)
SNP Type: INTRON Context (SEQ ID NO: 217):
AAAAAACAAATAATTGCATCAAAAAGTGGGCAAGAGACATGAATAGCGAATTCTCAAA
AGAAAATATACAAACAGCCACCAAACATATGAAAAAATGCTCR
ACATCACTAATTATCAGGGAACTGCAAATTAAAACCACAATGAGATACCACCTTACTCA
TGCAAGAATGGCCATAATTAAAAAGTCAAAAAATAATAGAT
Celera SNP ID: hCV1994986
Public SNP ID: rs11749573
SNP Chromosome Position: 158743793
SNP in Genomic Sequence: SEQ ID NO: 18
SNP Position Genomic: 70460
SNP Source: dbSNP; Celera; HapMap; ABI_Val
Population (Allele, Count): Caucasian (G, 20|A, 100)
SNP Type: INTERGENIC; UNKNOWN Context (SEQ ID NO: 218):
CACTAATATGAGAACAATCTCTTTAGGACTGGAAACCACGAAGTCAATTGAATTGAATG
CACCACAACCCAGTGAGTTAAATCTTTGTGGAAAGATTCCAS
AAATGCCTCTAAAGTTGCATCTATAAGCTTAATGATCTTATGTCTGTGTCTCCATGGATG
CCAAGTGATATGATTTGGATCTCTATCCCCACCCAAATCT
Celera SNP ID: hCV1994990
Public SNP ID: rs6861600
SNP Chromosome Position: 158752193
SNP in Genomic Sequence: SEQ ID NO: 18
SNP Position Genomic: 78860
SNP Source: dbSNP; Celera
Population (Allele, Count): Caucasian (C, 82|G, 38)
SNP Type: INTERGENIC; UNKNOWN Context (SEQ ID NO: 219):
CTGACTTGCTTCATACTTCTTCCTGCCTCCGCTAGCCTCCACCCAGGGAAGGTGTGCTTC
TCGGTAAGTCAGTTTGAGAGAAGCAGTGTAGTGTAGTGGTS
AATAGTCTGGATTTACATCTTTGATCTTCCATTTACTACGCTTGTGACCTAGGGGGTGTT
GCTTCCCCTCTCTGTTCCAATTATTTATCCATAAAATAGA
Celera SNP ID: hCV1994992
Public SNP ID: rs6887695
SNP Chromosome Position: 158755223
SNP in Genomic Sequence: SEQ ID NO: 18
SNP Position Genomic: 81890
SNP Source: dbSNP; Celera; HapMap; ABI_Val
Population (Allele, Count): Caucasian (G, 82|C, 38)
SNP Type: INTERGENIC; UNKNOWN Context (SEQ ID NO: 220):
TAAATTTCCAACTCATGCCTTTTGGGGGACACATTCAAACTATAGCAAATACTAAGTTA
AGGAAGTTTCAGCTCTGTCTGGCAGCCTCATAATATTTCAAY
GCTTCATCATTTGAATGCTTATTAATTAACCAACTTCCTGTATGCCATGTGATCAGATGT
CACAAGAGGAGTTCCTTTGGGATGAACTTAGTTCTTTGTG
Celera SNP ID: hCV1995017
Public SNP ID: rs4921496
SNP Chromosome Position: 158780649
SNP in Genomic Sequence: SEQ ID NO: 18
SNP Position Genomic: 107316
SNP Source: dbSNP; Celera; HapMap; ABI_Val; HGBASE
Population (Allele, Count): Caucasian (T, 27|C, 93)
SNP Type: INTERGENIC; UNKNOWN
```

TABLE 2-continued

```
Context (SEQ ID NO: 221):
GCTGGAATTCAGATCCCAGGTCTGTCAAAGCCTAATCCCAGCCAGCCTTCCTTCTGTTGC
TCCAACGGGGAGTCCTACTCAAAACTGTTCCTGGTCCTGTR
TGACAGCATTGATAAGACTCCTGGAAATTTTTGTTACTTCCTAGCCTCCACTTTCTACCT
TCCCATTTTCTCCTAATTTTCTCAATCTTTGTTGGGGTTT
Celera SNP ID: hCV1995018
Public SNP ID: rs4921500
SNP Chromosome Position: 158783091
SNP in Genomic Sequence: SEQ ID NO: 18
SNP Position Genomic: 109758
SNP Source: dbSNP; Celera; HapMap; HGBASE
Population (Allele, Count): Caucasian (A, 27|G, 93)
SNP Type: INTERGENIC; UNKNOWN Context (SEQ ID NO: 222):
CTGGTTCTTTCCCATCAGTGCTGTCACCAAAGAGAACCACCCATTTTCATATTATCTGTTT
TCGAACTCATATAAATGGAATCGTAGAGCATGCGTTCATTK
TGTCTAACTTCTTTTGTTCAAAATTATGTCTGGGAGATTCATCCATGTTCTAGCATGTAG
GAGCCGCCCACCCTTTTTCATTGCTGTGTAGTATTCTGTT
Celera SNP ID: hCV1995024
Public SNP ID: rs7702534
SNP Chromosome Position: 158790051
SNP in Genomic Sequence: SEQ ID NO: 18
SNP Position Genomic: 116718
SNP Source: dbSNP; Celera
Population (Allele, Count): Caucasian (T, 26|G, 90)
SNP Type: INTERGENIC; UNKNOWN Context (SEQ ID NO: 223):
AAGTCATAAAGCTGAAGAAACTTCTGGGTGTTCAGTGAGTAAATGAATGTTTGAGTGCA
ATGTGGAGACAGAATCATCATTGCACGTCTTATTTATAATTM
GGATTGTTCATCAGGTTGACCTTGAATCATGGATCCCATAACAGAAAGTTAGATACGGC
TGCTTTGAGAACTAAAAGGCCCAAAAAGTGCAGTCAGATCC
Celera SNP ID: hCV1995530
Public SNP ID: rs2421186
SNP Chromosome Position: 158850858
SNP in Genomic Sequence: SEQ ID NO: 18
SNP Position Genomic: 177525
SNP Source: dbSNP; Celera; HapMap; HGBASE
Population (Allele, Count): Caucasian (A, 84|C, 28)
SNP Type: INTERGENIC; UNKNOWN Context (SEQ ID NO: 224):
AATTACTTAAATATTTAAATAGCATGAAGGCCCATGGCAACTTGAGAGCTGGAAAATCT
ATACATAAATTAGCTGATTGTTTCAATGAGCATTTAGCATCK
AACTATACAAATACAGCAAAGATATCATTGTGATCCTAAAAAAACGTTTTAAAGCAAAT
CAGATAGAAATTATCTTTTTGGGTCTATTCCGTTGTGTCTT
Celera SNP ID: hCV2084293
Public SNP ID: rs3212227
SNP Chromosome Position: 158675528
SNP in Genomic Sequence: SEQ ID NO: 18
SNP Position Genomic: 2195
SNP Source: dbSNP; Celera; HapMap; HGBASE
Population (Allele, Count): Caucasian (T, 93|G, 27)
SNP Type: UTR3; INTRON Context (SEQ ID NO: 225):
ATCAGATAGAAATTATCTTTTTGGGTCTATTCCGTTGTGTCTTTAAACATTTTGCTTAATA
TCTTCCACTTTTCCTCCAAATTTTCATCCTGGATCAGAAY
CTGGAAGAGAATGCCAAAAGTTGATGTGGGGTGACATTGTAACAGCAATGTCTCTTCTT
ATTTCTCACAACATATGATCCTGGGCAACTGGGTTTCAGGG
Celera SNP ID: hCV2084294
Public SNP ID: rs3213120
SNP Chromosome Position: 158675686
SNP in Genomic Sequence: SEQ ID NO: 18
SNP Position Genomic: 2353
SNP Source: dbSNP; Celera; HapMap; HGBASE;
Population (Allele, Count): Caucasian (C, 117|T, 3)
SNP Type: MICRORNA; UTR3; INTRON Context (SEQ ID NO: 226):
GGAAAATGTCTTAGGTTCTCTGTGTCTGTTTCCTCACTTATAAATAGGGATAACAATAAT
GCCTACTTCATAGAATTATAGTTCAAGGTAAAAATCACGTY
AAACTCTTAGCAAGTCTTTAGCACATAGGAAGCACTCAATATCACCTATTAGTCATACA
GATCTTAAATAGGGAAAGTACTTGCCAAGATGTAAAATAAT
Celera SNP ID: hCV2084295
Public SNP ID: rs2195940
SNP Chromosome Position: 158676930
SNP in Genomic Sequence: SEQ ID NO: 18
```

TABLE 2-continued

```
SNP Position Genomic: 3597
SNP Source: dbSNP; Celera; HapMap; HGBASE
Population (Allele, Count): Caucasian (C, 110|T, 10)
SNP Type: INTRON Context (SEQ ID NO: 227):
GGCTTTGTCCAGTGATTTTAAAAGTGGGGTGAAAGGAGTCTGGGGCGGTACAAAAGGG
CCTCTGGAACCTTGCAACAGGCAAAGGAATTCTGCTGTAAGGY
GAGGAAGCTGGGAAGCCAATATCTTAGCCTCTATAAGTGTAGACATTCTGTTTAGTAAA
ATAATTTTATAATATCTGGAACAGCCAGGAGCTATCCATTT
Celera SNP ID: hCV2084296
Public SNP ID: rs2853696
SNP Chromosome Position: 158677238
SNP in Genomic Sequence: SEQ ID NO: 18
SNP Position Genomic: 3905
SNP Source: dbSNP; Celera; HapMap; ABI_Val; HGBASE
Population (Allele, Count): Caucasian (T, 26|C, 94)
SNP Type: INTRON Context (SEQ ID NO: 228):
CCCCTCTGACTCTCTCTGCAGAGAGTGTAGCAGCTCCGCACGTCACCCCTTGGGGGTCA
GAAGAGCTGAAGTCAAAGACAGAAATTAGCCTGTGTTACACM
TTGGGGAGAGAGTTCCTAGTGATTGTAGCCAGTAAGGCAGGTAAGGCCTCAACTGTTGT
CTGAGGACACAGTTTCTCCAACTGGGCTGATTTCTACCCAG
Celera SNP ID: hCV2084297
Public SNP ID: rs919766
SNP Chromosome Position: 158680142
SNP in Genomic Sequence: SEQ ID NO: 18
SNP Position Genomic: 6809
SNP Source: dbSNP; Celera; HapMap; HGBASE
Population (Allele, Count): Caucasian (A, 110|C, 10)
SNP Type: INTRON Context (SEQ ID NO: 229):
GTCTGCTTCAGGGCCCCTAAGATCTACGCCCTGGAGCTCTTGTTTTTATTTTTGACTCAA
GGTGCAATTTCAGCAAGTCATTTGTAGCTTTGAATTCTCCK
TTTATCCCTTTCTTTGGTGCTATGAGGCTTCAGGAAGCATGGCCAGGCAATTTGGATGAG
TGGGTTCAAACACAGCAGAGACTATTCTCAGTTCCCAATA
Celera SNP ID: hCV2084298
Public SNP ID: rs2853694
SNP Chromosome Position: 158681666
SNP in Genomic Sequence: SEQ ID NO: 18
SNP Position Genomic: 8333
SNP Source: dbSNP; Celera; HapMap; HGBASE
Population (Allele, Count): Caucasian (G, 65|T, 55)
SNP Type: INTRON Context (SEQ ID NO: 230):
TATCTGCCTTACATTTGACTGAGGATTAAATGAAAAAAAAAAAAAGCACGTAAAGTACT
TAGCACAGTGTCTGCCACACAGTAAATTCGGTGTTAGTTATY
GTTACTTATAGACTGAGGAGTCAGCCAACTGTACAGAGAAACTCTCTTAACAATTTTCC
ATGGATATTTAAGGATTTCGTTCCCTCTGTTTTAAATCACC
Celera SNP ID: hCV2084301
Public SNP ID: rs3213093
SNP Chromosome Position: 158683557
SNP in Genomic Sequence: SEQ ID NO: 18
SNP Position Genomic: 10224
SNP Source: dbSNP; Celera; HGBASE
Population (Allele, Count): Caucasian (C, 93|T, 27)
SNP Type: INTRON Context (SEQ ID NO: 231):
GTGAGGGTCCAGAAACTTGTATGATCCAGGTATTCGTTTATTGATTTTTTTTCAAGTAAT
TAGTGAGCATTTACCATGTATGAAGTGCTGAGGATAAATAR
TGAGCAAGGCAAGCAGGCTTCTGCCCTCACAAAGCTCATATTCTAGTCCTGCGTATGTG
TGTTGGTGGGGAAATGTAAACAATATACAAGTAAACAAAC
Celera SNP ID: hCV3169817
Public SNP ID: rs4921499
SNP Chromosome Position: 158781130
SNP in Genomic Sequence: SEQ ID NO: 18
SNP Position Genomic: 107797
SNP Source: dbSNP; Celera; HapMap; HGBASE
Population (Allele, Count): Caucasian (A, 26|G, 92)
SNP Type: INTERGENIC; UNKNOWN Context (SEQ ID NO: 232):
TTCATGGAGCCATATTTTCTGGTCATAATTGTGTATCAGGTTCATTCATGCTAATGAGAA
AGGGATTCCAGATTTTCTTTGCATCTGTCTGCTTCTCACAK
GGCTGTTAAGAAGCCACCTGCCATTCTGACAATTTCATGTCCTTAGCCATAACTACTTGT
CCTCTCTCTTGAATCTTAAGATCTTTTTGCCTTCCAGACA
```

TABLE 2-continued

```
Celera SNP ID: hCV7537839
Public SNP ID: rs1368439
SNP Chromosome Position: 158674592
SNP in Genomic Sequence: SEQ ID NO: 18
SNP Position Genomic: 1259
SNP Source: dbSNP; Celera; HapMap; HGBASE;
Population (Allele, Count): Caucasian (G, 26|T, 94)
SNP Type: MICRORNA; UTR3; INTRON Context (SEQ ID NO: 233):
GAAGTCCCACCAAGACTCCCAAGGATAGCGTGTTAGCATACAAGCTGAATAGCCTGTGT
TGCAGTCCCTGCTAGTCAGGGTCTTCTGGATAATGCATTGCM
TGTGTGAGGACTGGCCTGGTCCTCTGCAGGCTGAATTCTGCATTTAGCAGCTCAGTGTCC
CTTCCACGGGCCCCAGTTTCTTCATCAGGAAGGTGAGGGG
Celera SNP ID: hCV7537857
Public SNP ID: rs983825
SNP Chromosome Position: 158707543
SNP in Genomic Sequence: SEQ ID NO: 18
SNP Position Genomic: 34210
SNP Source: dbSNP; Celera; HapMap
Population (Allele, Count): Caucasian (C, 30|A, 86)
SNP Type: INTRON Context (SEQ ID NO: 234):
GCTTGTCCCAAATTTCTTTCTATTTGAACTTCCTTGGTGATAAAAATTCTCCTGTGGGAG
AATTTTTGTTGTGAACATTTTGGACATTTTGTTGTGTTTGS
CTCTAGCTAAAACATGAGCATTTGTTCCTAGAAGGGATAACATTTTTACACTTCTGTTGC
CATTAGTATGTGAGCAAGAATTAATATATGAACTCATTGT
Celera SNP ID: hCV7538743
Public SNP ID: rs1363670
SNP Chromosome Position: 158716689
SNP in Genomic Sequence: SEQ ID NO: 18
SNP Position Genomic: 43356
SNP Source: dbSNP; HapMap; ABI_Val; HGBASE
Population (Allele, Count): Caucasian (G, 20|C, 100)
SNP Type: INTRON Context (SEQ ID NO: 235):
TGCTTACTAGAGACCAAAATGCCAAGATTTCAACGGGAGCCAGCCACCCTGGTTTCTAT
TTTGATGTGATTACTTAGTCATTTAAAGTCAGGTTAATGTTS
GCCAACAACAGATGGGGTCAGGACACAGGAGTTCTGCAGCTCACTGAAACTGGACAGT
CTTTTAGGGCACCCAGCTCACAAGGCCACACCGTGGCCCGCC
Celera SNP ID: hCV7538755
Public SNP ID: rs918520
SNP Chromosome Position: 158758888
SNP in Genomic Sequence: SEQ ID NO: 18
SNP Position Genomic: 85555
SNP Source: dbSNP; Celera; HapMap; ABI_Val; HGBASE
Population (Allele, Count): Caucasian (C, 20|G, 100)
SNP Type: INTERGENIC; UNKNOWN Context (SEQ ID NO: 236):
TGTTTTAGGATCAAAATAATGAAAAAGAATAGAAACCATTTCAACTCAGAAAATAATTC
AAAGATGGGAAAAAGGTGTGTACCAAATTCATTGCTCTAATY
ATTTCTGTTCTGATAAAAGGAGTTTACAGCAAAGGAATAACTTTTCTGTGTCTCTGAGGC
TTTGGAAAAACAAGGCATCAAGAAGCTTTGGGGTGTGGTG
Celera SNP ID: hCV7538761
Public SNP ID: rs1422878
SNP Chromosome Position: 158771795
SNP in Genomic Sequence: SEQ ID NO: 18
SNP Position Genomic: 98462
SNP Source: dbSNP; Celera; HapMap; ABI_Val; HGBASE
Population (Allele, Count): Caucasian (C, 68|T, 52)
SNP Type: INTERGENIC; UNKNOWN Context (SEQ ID NO: 237):
GGTAAACCATGGATGTGGTTCTACAGATGTTGCCACAACAGGAAGACAAAATCTCACA
GCTAACAGAGGTCACAGCTTTTGGAAACAGTGGTTGCGACACR
GAGGAAACTCCCCCTCCCAGCCCTACCCCAAGCACATCCTTGCTTCTCTCAGTCACGCC
AGTTACACCAACAGGGGCAGCTCTGGGGAGGACATTTGGAA
Celera SNP ID: hCV7538765
Public SNP ID: rs1422877
SNP Chromosome Position: 158772090
SNP in Genomic Sequence: SEQ ID NO: 18
SNP Position Genomic: 98757
SNP Source: dbSNP; Celera; HapMap; HGBASE
Population (Allele, Count): Caucasian (A, 57|G, 51)
SNP Type: INTERGENIC; UNKNOWN
```

TABLE 2-continued

```
Context (SEQ ID NO: 238):
CCATTTCAACTCAGAAAATAATTCAAAGATGGGAAAAAGGTGTGTACCAAATTCATTGC
TCTAATCATTTCTGTTCTGATAAAAGGAGTTTACAGCAAAGR
AATAACTTTTCTGTGTCTCTGAGGCTTTGGAAAAACAAGGCATCAAGAAGCTTTGGGGT
GTGGTGGGTGTGGTGGGGCAGCCTACTGCTTGTTGAGGTAA
Celera SNP ID: hCV11264606
Public SNP ID: rs1984811
SNP Chromosome Position: 158771830
SNP in Genomic Sequence: SEQ ID NO: 18
SNP Position Genomic: 98497
SNP Source: dbSNP; Celera; HapMap; HGBASE
Population (Allele, Count): Caucasian (G, 20|A, 76)
SNP Type: INTERGENIC; UNKNOWN Context (SEQ ID NO: 239):
CTTTGTAATGTGCTATTGAATTTGATTTGCTAGTATTTTGTTGAGGATTTTTGCATCTATG
TTCATCAGGAATATTGATCTATAGTTTTATTTTTTTGCTR
TGTCCTTGTCTGGTTTTGGTATTAGGGTGATATTGATCTCATAGCATGAATTAGGGATAA
TTCCTTCCTCCTCAATTTTTTTTAATAGTTTCAGGAAGA
Celera SNP ID: hCV11264637
Public SNP ID: rs6864071
SNP Chromosome Position: 158733765
SNP in Genomic Sequence: SEQ ID NO: 18
SNP Position Genomic: 60432
SNP Source: dbSNP; Celera; HapMap; ABI_Val
Population (Allele, Count): Caucasian (G, 81|A, 39)
SNP Type: INTERGENIC; UNKNOWN Context (SEQ ID NO: 240):
GGAGAGCAGGAGCAGGAGCTGGGGTGATTGCCTTTGGAAGCCATTAGGAACAAACTGT
GTACCAGCCTGTGGCAGTGTCTAGGGGTTGTCCATGACCTCTR
GAGCCCAAGGGGGCATGTGTTACAAACAATACTCTTTTAGCATTTGCTGTCCACAGACA
GCTAAGTGTTTACCCGCTCAGTGGAGGGTTGGGGTGACAGC
Celera SNP ID: hCV11269323
Public SNP ID: rs11135059
SNP Chromosome Position: 158703915
SNP in Genomic Sequence: SEQ ID NO: 18
SNP Position Genomic: 30582
SNP Source: dbSNP; Celera; HapMap
Population (Allele, Count): Caucasian (G, 81|A, 39)
SNP Type: INTRON Context (SEQ ID NO: 241):
TTTGGGTGGCCTCAGCTTCCTTTTTTTTTTCTTTGTATATTCTAAGTGGATGCTTGAAGTC
ATTTCATTTATTGACATTGTCAGAATCAAAATGTGGTGAY
ATGAAATCAGTCAGGGCCAAAGTTGTTGTACTCAGAAACGTAGTATAAATCATGCAAAC
ACTATATAAAGCACATTTCAAATGAATCAGGTATTTAAAAC
Celera SNP ID: hCV11314640
Public SNP ID: rs1833754
SNP Chromosome Position: 158751505
SNP in Genomic Sequence: SEQ ID NO: 18
SNP Position Genomic: 78172
SNP Source: dbSNP; Celera; HapMap; ABI_Val; HGBASE
Population (Allele, Count): Caucasian (T, 112|C, 8)
SNP Type: INTERGENIC; UNKNOWN Context (SEQ ID NO: 242):
TTAATGGTTATGGGCCATGCATTGAAGGACCACCCTGTCTGTGCTAATCCCTCACTTTGC
ACTGAACATGGAACTAAGCTGAGCCTCTCCCTGGGGATGAR
ATGATAGATTTTCTATTTACTGCCCTTTCTTTTGTCTTTTCATAGCTTTTGGTGCGGACAT
GTCTTGGAGCAGTTACAGTCAATTGTCTCTATGCTCAAT
Celera SNP ID: hCV15803290
Public SNP ID: rs2421047
SNP Chromosome Position: 158678885
SNP in Genomic Sequence: SEQ ID NO: 18
SNP Position Genomic: 5552
SNP Source: dbSNP; Celera; HapMap; HGBASE
Population (Allele, Count): Caucasian (G, 93|A, 27)
SNP Type: TRANSCRIPTION FACTOR BINDING SITE; INTRON Context (SEQ ID NO: 243):
GCTCATTTGCTGTTGAGCAGTGGGAGCAACTTGTTGGCCAAGTTACTCGCTGAGCCTCA
GTCTCTTTGTCTATAAAATGGACCTAATACTTATCTCAAAGR
CTTGTTGGGAAAGGCAATGAGATAACATATTATAGAAGGCAACCAATAACATATTAACT
TGAACCTAGAGGAAGAGGTAAGGGAACAATTCGGTATCTGT
Celera SNP ID: hCV15894459
Public SNP ID: rs2546892
SNP Chromosome Position: 158688053
SNP in Genomic Sequence: SEQ ID NO: 18
```

TABLE 2-continued

```
SNP Position Genomic: 14720
SNP Source: dbSNP; HapMap; HGBASE
Population (Allele, Count): Caucasian (G, 103|A, 17)
SNP Type: INTRON Context (SEQ ID NO: 244):
GAGAAACTTCCAGCACAATTTCAGTTTCATAGAGAATACGGCAGGGCACAATATTCAGC
AGAGTAACATAGTGGTTAAAAGCTCAGGGTGTCGAGAACAAY
GAACCAAGACTGTCATCCTGTCTCCACTAACCAGCTGGGGGATTTGGAACAAGGTATTT
CATTATCATGAGCCTCAGTTTCCTCATCTGTAAAATGATAA
Celera SNP ID: hCV29927086
Public SNP ID: rs3213094
SNP Chromosome Position: 158683347
SNP in Genomic Sequence: SEQ ID NO: 18
SNP Position Genomic: 10014
SNP Source: dbSNP; HapMap; HGBASE
Population (Allele, Count): Caucasian (C, 93|T, 27)
SNP Type: TRANSCRIPTION FACTOR BINDING SITE; INTRON Context (SEQ ID NO: 245):
CTCACCTAACTGCAGGGCACAGATGCCCATTCGCTCCAAGATGAGCTATAGTAGCGGTC
CTGGGCCCGCACGCTAATGCTGGCATTTTTGCGGCAGATGAM
CGTGGCTGAGGTCTTGTCCGTGAAGACTCTATCTTTCTGCAAAAGAGAAGGAAAGCTGT
GAAGACCCCTTGGCAACATAGTCACAGGGTAAGCTGAGCCT
Celera SNP ID: hCV31985602
Public SNP ID: rs3213119
SNP Chromosome Position: 158676366
SNP in Genomic Sequence: SEQ ID NO: 18
SNP Position Genomic: 3033
SNP Source: dbSNP; HapMap; HGBASE;
Population (Allele, Count): Caucasian (C, 115|A, 1)
SNP Type: MISSENSE MUTATION; INTRON Context (SEQ ID NO: 246):
CCAATACAGGAGAGAGCTGAAGGGAATTCCCAGGCTGATGGTGAAAGATGGCCCACAA
TGACAGCTGTTTGGCAGGTCTAGAAACCCATTACAGGTTGAAR
GGAAAAGGTGGAAGTCTCCACGGTGGATGTTCCTAAGAAGAGTGGAACTGAGAGACTA
CTAATGGATTCAGGTATATTGAGAGAAATTCTTAGGGCTCCA
Celera SNP ID: hCV27106331
Public SNP ID: rs12657996
SNP Chromosome Position: 158836891
SNP in Genomic Sequence: SEQ ID NO: 18
SNP Position Genomic: 163558
SNP Source: dbSNP; Celera; HapMap
Population (Allele, Count): Caucasian (G, 72|A, 26)
SNP Type: INTERGENIC; UNKNOWN Context (SEQ ID NO: 247):
TAAGGCTTCCAGTCAATAGAAGGCTGTTATTAGTTAAGTTCTGGCTGAGTCAAAAGTGA
TACATAAATTTTCAACTGCATGGTGGGGTCAACATTACTAAM
CCCCTCACCCTTCATGGGTGAACTGTATTTTTATATCTATATCTAATCTATATATCTATAT
ATCTCTCTATATATATTTAGTTTGGGTGGCCTCAGCTTC
Celera SNP ID: hCV27106358
Public SNP ID: rs6556416
SNP Chromosome Position: 158751323
SNP in Genomic Sequence: SEQ ID NO: 18
SNP Position Genomic: 77990
SNP Source: dbSNP; Celera
Population (Allele, Count): Caucasian (A, 32|C, 86)
SNP Type: INTERGENIC; UNKNOWN Context (SEQ ID NO: 248):
ATGATTTATGAAGAAAAAGAGGTTTAATGGACTCACAGTTCCACGTGGCTGGAGAGAG
CTTACAATCATGGTGGAAGGTGAAGGAGGAGCAAAGCCATGTY
GTACATGGAGGCAGGCAAGAGAGTGTGTGCAGGGGAACTTCCCTTTATAAAGCCATCG
GATCTCGTGAGACTTATTCGCTATCACGAGAAGAGCATTGGA
Celera SNP ID: hCV27106359
Public SNP ID: rs12522665
SNP Chromosome Position: 158750818
SNP in Genomic Sequence: SEQ ID NO: 18
SNP Position Genomic: 77485
SNP Source: dbSNP; Celera; HapMap
Population (Allele, Count): Caucasian (C, 76|T, 34)
SNP Type: INTERGENIC; UNKNOWN Context (SEQ ID NO: 249):
TATTGGCCTGAAGCCTGAATCATCAACTCAGTAAATAAAATACTGGGAACAATTAAACA
AATAAAGTGAATACTATGAGAGAATGAGATAAGCCTCAAGAK
ATTGCTACCATTCCAGCCCCATAGGACACAGTGAACTGGCCCACACTCCAAGTACCTAA
CTACTACAACCAGAGCACAAAGACTCTCTATGATAAAGGAA
```

TABLE 2-continued

```
Celera SNP ID: hCV27106365
Public SNP ID: rs4379175
SNP Chromosome Position: 158737506
SNP in Genomic Sequence: SEQ ID NO: 18
SNP Position Genomic: 64173
SNP Source: dbSNP; Celera; HapMap; ABI_Val
Population (Allele, Count): Caucasian (G, 81|T, 39)
SNP Type: INTERGENIC; UNKNOWN Context (SEQ ID NO: 250):
AACAAGGGGCTTCTTGAGAGGAAATGAAAGGAGACGGAGATGCGGTTTTGCCTTAAGG
TTTTTAATGTGAGCCACTGAGAAGATTCATTTTGAAATAGAAR
GATGTGTCTGACAGTGTGATGTAAATGCAGGCATTTTGGAGTCCCTGCTGGAGAACACA
CAGAGGTGAGTAGGGGTTCTCCAGTGACCTTGTGGGAGTCT
Celera SNP ID: hCV27106385
Public SNP ID: rs4244437
SNP Chromosome Position: 158705695
SNP in Genomic Sequence: SEQ ID NO: 18
SNP Position Genomic: 32362
SNP Source: dbSNP; Celera; HapMap; HGBASE
Population (Allele, Count): Caucasian (G, 31|A, 87)
SNP Type: INTRON Context (SEQ ID NO: 251):
CCTGGGCCCGCACGCTAATGCTGGCATTTTTGCGGCAGATGACCGTGGCTGAGGTCTTG
TCCGTGAAGACTCTATCTTTCTGCAAAAGAGAAGGAAAGCTR
TGAAGACCCCTTGGCAACATAGTCACAGGGTAAGCTGAGCCTGTTTCTGCAATGCATAC
TCTCCCAAAACAAGCCCATCTTGGTCTTAGGGCACTGTGCT
Celera SNP ID: hCV27106395
Public SNP ID: rs11574790
SNP Chromosome Position: 158676424
SNP in Genomic Sequence: SEQ ID NO: 18
SNP Position Genomic: 3091
SNP Source: dbSNP; Celera; HapMap;
Population (Allele, Count): Caucasian (G, 110|A, 10)
SNP Type: INTRON Context (SEQ ID NO: 252):
TAAAAATCTGGTTAGTGTTGTTCATTAAATGTCCGTTAAGTACTTTGGTAACTGCAGATG
AAAGACCCTGTAGGGGACAAACACTTGTTATTAACAACCR
TATGCTGTCAAGTGTGGGCTTATAACACGGGACCATATGCTCCAAAGGTTGGCAAAGAA
TGACAGAAGCCACCCACCATTCCTCCAGGCCAGGAGCAGAG
Celera SNP ID: hCV27467944
Public SNP ID: rs3181224
SNP Chromosome Position: 158673428
SNP in Genomic Sequence: SEQ ID NO: 18
SNP Position Genomic: 95
SNP Source: dbSNP; HapMap; HGBASE
Population (Allele, Count): Caucasian (A, 110|G, 10)
SNP Type: INTRON Context (SEQ ID NO: 253):
GCAATGCTCAACTGTTTCAGTCAAATACCTTAAAAATGAGCATTCCTGGGTTGGGTGAC
GGAATATTGACAAATTACAGCTTTGTCAGAACTGCTACTAAS
TCTAGGCGGACCTTGCTATGTACTTTATTCCCTTATAAAGTTTGTGAGTGGCAGAGACAG
GCCTAGAAGTCAAGCCTTCTTGGACACTGCTCAGTGCTGT
Celera SNP ID: hCV27471935
Public SNP ID: rs3212217
SNP Chromosome Position: 158687708
SNP in Genomic Sequence: SEQ ID NO: 18
SNP Position Genomic: 14375
SNP Source: dbSNP; HapMap; HGBASE
Population (Allele, Count): Caucasian (G, 93|C, 27)
SNP Type: INTRON Context (SEQ ID NO: 254):
TGTGTGCTGGAGCACCCAGAACTGAAGGACTTGGGTTAGGGACAGGAACGGTAATACA
GAGGCGAACTTTCAGGTTCTGGCAACGACCTGGTCACCAGCCM
TTGCTGTAGGGGTTTAGCTTCTTGTTTTCCAAGTTCAAAGACTACTCTCTCCCATATA
GAGAACCTAGTGGTTCTAAAATTTGAGTGACTGTCAGGAT
Celera SNP ID: hCV27486507
Public SNP ID: rs3212219
SNP Chromosome Position: 158687039
SNP in Genomic Sequence: SEQ ID NO: 18
SNP Position Genomic: 13706
SNP Source: dbSNP; HGBASE
Population (Allele, Count): Caucasian (C, 89|A, 27)
SNP Type: INTRON
```

TABLE 2-continued

```
Context (SEQ ID NO: 255):
GTTCAAAGACTACTCTCTCCCATATAGAGAACCTAGTGGTTCTAAAATTTGAGTGACTG
TCAGGATAACCTGGAAGCACTGCTACAACAGACGGCTGAGTM
CCACCCCCAGAGTGTCTGATTCAGCAGGCATGAGGGCCTGAGAATATGCATTTCTAGAA
AGTTTCCAGGGGAAGCAGATGCTGCTGGCGCTAAGACCACA
Celera SNP ID: hCV27508808
Public SNP ID: rs3212218
SNP Chromosome Position: 158687174
SNP in Genomic Sequence: SEQ ID NO: 18
SNP Position Genomic: 13841
SNP Source: dbSNP; HapMap; HGBASE
Population (Allele, Count): Caucasian (C, 81|A, 25)
SNP Type: INTRON Context (SEQ ID NO: 256):
GAATGGATAGCAAACGCACAGGCTCTGGAGTGGGAGCAAGCTTGGTGTGTTGAGGGAT
AGAAATACACAGAGCATGGCAAATACAGCAAGTGGTGTGAAAY
GGGGTTGGAAAAGGTGGCGCAGGCCAGATCACTAGGACCAAGGAGTTTGAAATTTATT
CCTAGTGCAGTATATCAGGTTGTATTTTTATCACTGGATAAT
Celera SNP ID: hCV27883430
Public SNP ID: rs4921493
SNP Chromosome Position: 158768685
SNP in Genomic Sequence: SEQ ID NO: 18
SNP Position Genomic: 95352
SNP Source: dbSNP; HapMap; HGBASE
Population (Allele, Count): Caucasian (T, 64|C, 50)
SNP Type: INTERGENIC; UNKNOWN Context (SEQ ID NO: 257):
ATCCTCAGAAGTGGGCGGCAGAGAAGGAGGAACGTGCTTGAGTCGCAGTCCCCAAAAA
GGGAGGAACTCATTGGCCCAGCTTAGGCCTGGTGTCTGCCTAY
CTGTGGTTCAGTCAGCTGTGGTCGGTGGGCAGGACACACCTGAAGGAGCATATCTTGGC
TGTGTGGGTTGGGCAGACATCCCACAATGCTCATGTAGGGG
Celera SNP ID: hCV28024675
Public SNP ID: rs4921230
SNP Chromosome Position: 158812974
SNP in Genomic Sequence: SEQ ID NO: 18
SNP Position Genomic: 139641
SNP Source: dbSNP; HapMap; HGBASE
Population (Allele, Count): Caucasian (C, 88|T, 30)
SNP Type: DONOR SPLICE SITE; TRANSCRIPTION FACTOR BINDING SITE Context (SEQ ID NO: 258):
GTGGTCTGAACGTTTATGTCTCCCTAAAATTCATATGTTGAATTCCTAACCCCCAAGGTG
AGAGTGTTGGGAGGTGGAGCCTTTTAGTCTCCTGGCTGGGM
TTAGTGGCCTGATAACATAGACTCCAGAGAGCTGGCTTATTCCTTCCACTATGTGAGGA
CACAGCAAGAAGCCGCTGTCTGTGGGGAAACAGAGGCTTAC
Celera SNP ID: hCV29349404
Public SNP ID: rs7704367
SNP Chromosome Position: 158754071
SNP in Genomic Sequence: SEQ ID NO: 18
SNP Position Genomic: 80738
SNP Source: dbSNP; HapMap
Population (Allele, Count): Caucasian (A, 75|C, 37)
SNP Type: INTERGENIC; UNKNOWN Context (SEQ ID NO: 259):
AGTTGGATTCCCCAAAATAATTAGTTAGTTAATTTGTTGACTGATTGATTGACACATTGC
TAGCTCCTCTCAGACTGCCCAGTCTTCCTCATGCCCAAAGK
GCTCTCATTCTGTTCATGATAACGCCCAAAATCTTTACCTTGGCACACTCGTTTCTCCAT
GATCTGCCCCTACTCCCTAATCGCTGTCACCTCCTACAAT
Celera SNP ID: hCV29349406
Public SNP ID: rs6556411
SNP Chromosome Position: 158715801
SNP in Genomic Sequence: SEQ ID NO: 18
SNP Position Genomic: 42468
SNP Source: dbSNP; HapMap
Population (Allele, Count): Caucasian (G, 32|T, 88)
SNP Type: INTRON Context (SEQ ID NO: 260):
CTCTTATTTTTAAGATGAGAAACTTAAAGCTTAGAGAAGGAATGTGACTTTCTGGATCA
ACATCTAGCAGTTGTTTATTTAGTGCTTACTACATAAAGAGM
ACTGGGCTAGAAGCAGTTGAGAGAGAAAAAAAGGGCTTACCTGGATCCCGCTTCCTAG
GAGCAAATACTTTTACTCAATAAATATTTATTAAGTCAGTGT
Celera SNP ID: hCV30449508
Public SNP ID: rs3212220
SNP Chromosome Position: 158686773
SNP in Genomic Sequence: SEQ ID NO: 18
```

TABLE 2-continued

SNP Position Genomic: 13440
SNP Source: dbSNP; HapMap; ABI_Val; HGBASE
Population (Allele, Count): Caucasian (C, 93|A, 27)
SNP Type: INTRON Context (SEQ ID NO: 261):
ATGTCACCAACAAGAGGCTACCCCCTGGGGAAACCTAACAGGAAAAAGGTAGTTGAGC
CAGGAAAAGCCACCAGACCCTTTCTCTTGGCTTGAGGCATCAY
ATACATTTGAATAATAATCAAATTAACAATGTAATATGACTGTTTAGCAACAATGATGT
GCTAATCATGGTTTTACATGGATTATCTTTAGTCATTAAAT
Celera SNP ID: hCV31985570
Public SNP ID: rs12651787
SNP Chromosome Position: 158772323
SNP in Genomic Sequence: SEQ ID NO: 18
SNP Position Genomic: 98990
SNP Source: dbSNP; HapMap
Population (Allele, Count): Caucasian (T, 64|C, 50)
SNP Type: INTERGENIC; UNKNOWN Context (SEQ ID NO: 262):
TAAATAAAATAAAATAAAGTAGAAAAGAAACAAAAATTATAAGATAGGGACATTAAAT
GGAGTTAGAAATGAGGCTAATAAATAATGAATATGCTGCACCR
TGGAATACTACTCAGCCATAAAACAGAACAAAATAATGGACTTTGCAGCAACTTGGAT
GGAGCTGGAAGCCATTATCTTAAGTGAAATAATTCACAAATG
Celera SNP ID: hCV31985582
Public SNP ID: rs6556412
SNP Chromosome Position: 158719963
SNP in Genomic Sequence: SEQ ID NO: 18
SNP Position Genomic: 46630
SNP Source: dbSNP; HapMap
Population (Allele, Count): Caucasian (G, 79|A, 39)
SNP Type: INTRON Context (SEQ ID NO: 263):
CATTCTCATTTAAATTTGTATATCCCTGATTATTTTGAGGCCAGGCACCTTCTCAGTCTA
TCAGTTATCTGTTAAGTTTTGAATCGATTTGTCCATTGGY
TGTCTTACCTTATTGATTGGTAGAAGCCCTTAATTTTGGCATGAGCTCTTTATTAGTTAC
ATGTGTGGCAAATATTTTCTCCCACTCAGGGACTTGCTGT
Celera SNP ID: hCV30611467
Public SNP ID: rs6869411
SNP Chromosome Position: 158714182
SNP in Genomic Sequence: SEQ ID NO: 18
SNP Position Genomic: 40849
SNP Source: dbSNP; HapMap; ABI_Val
Population (Allele, Count): Caucasian (T, 71|C, 49)
SNP Type: INTRON Context (SEQ ID NO: 264):
GTTATTTTTTCTTCTTACAAAAGTTGTTATTCAAGGATTATTAGCAGCCACCATTAATTA
GGCACTTCATTATACTGTTTTACTTACCTCATACTCACCCR
ATTATTGAAGCAGGGATTCCTGCCCTAGGATTATAGGGATGGCCGACACTTGACACTTG
ACACTGAACAGATGAGATTGACAGCAGCTTGTCAGTCACAC
Celera SNP ID: hCV30017148
Public SNP ID: rs9313808
SNP Chromosome Position: 158753422
SNP in Genomic Sequence: SEQ ID NO: 18
SNP Position Genomic: 80089
SNP Source: dbSNP; HapMap
Population (Allele, Count): Caucasian (A, 22|G, 98)
SNP Type: INTERGENIC; UNKNOWN Context (SEQ ID NO: 265):
AAAGAACGTTATTGATGGAAATTTAGGGGTGTTTGGGGAATATTACTAAAATTTGTGTG
TAACCAAATTTGTGACCTTCTAACAAATGTCCCCCTGTAGAS
CTGTGAGAAACAATATTAGGGTTGACCCACTCAGTTCATGCTTTTTTTTTTTCTGTTAA
AAAAAGCCAGCATTTCAAGCAGTGAGTAGACCAGTAAGCT
Celera SNP ID: hCV32389145
Public SNP ID: rs4921504
SNP Chromosome Position: 158840941
SNP in Genomic Sequence: SEQ ID NO: 18
SNP Position Genomic: 167608
SNP Source: dbSNP; HapMap; HGBASE
Population (Allele, Count): Caucasian (C, 89|G, 31)
SNP Type: INTERGENIC; UNKNOWN Context (SEQ ID NO: 266):
ATAGCTTTTCATTTTTTAACTGGGGCCAAAGTTAGTTAATCCACAAGAATGGGGATCCC
AGCTGTCATTTTGGTTGATATCACAACTGACGACCAAGACCR
TCACAAATATGGGAGCAAGTCTGATTTGTAACATTATTATAATTATGAATCCAATTACTT
TAAGGAATGCACGAAAGGCTTTTTAAAAATTTCAATAGTA TABLE 2-continued

```
Celera SNP ID: hDV71045748
Public SNP ID: rs6894567
SNP Chromosome Position: 158689546
SNP in Genomic Sequence: SEQ ID NO: 18
SNP Position Genomic: 16213
SNP Source: dbSNP; HapMap
Population (Allele, Count): Caucasian (A, 94|G, 26)
SNP Type: INTRON Context (SEQ ID NO: 267):
ACAGACCTAGTTAGACCATAGTCCATATTTCAAATATAATTACATGTGCTCATAGCTGA
GAACCTTCTCCTGGGATGGATGCATTTCACCAGGTCACTGCY
GAAATGTTGTACTTTTATGGATGGTGATGAGGAAGCATCTGTTTTAGGTGTGGTATTTCC
TGGAGGCAGAAAACTGCTTGAGTTAGCTCATTCAGTTTTT
Celera SNP ID: hCV31985592
Public SNP ID: rs7709212
SNP Chromosome Position: 158696755
SNP in Genomic Sequence: SEQ ID NO: 18
SNP Position Genomic: 23422
SNP Source: dbSNP; HapMap; ABI_Val
Population (Allele, Count): Caucasian (T, 76|C, 44)
SNP Type: INTRON Context (SEQ ID NO: 268):
AAAACATATGGGTTGGGTTATCCACTTCAATGACTGCACATTAAGCAAGAGTATAGTGT
ACCATGTTTTATTTAACCATTCCTCTGCTGATTATGTCTTTW
TGCACTTGGAGAAACATTTCTTTAGTAAGCATTTTCCTTTTAAAGATGAAAAAGTGAGA
CCCCAATGCTTAATTTACTCAGTGAAATAATGGTAAAGTCA
Celera SNP ID: hDV75439995
Public SNP ID: rs3213097
SNP Chromosome Position: 158681257
SNP in Genomic Sequence: SEQ ID NO: 18
SNP Position Genomic: 7924
SNP Source: CDX; dbSNP
Population (Allele, Count): Caucasian (T, 89|A, 27)
SNP Type: INTRON Context (SEQ ID NO: 269):
GTGATTCAGATCTGGGATGGGGCTCAGGAACCTGCATTTTAACAATGGAGGTTCTAATG
TGGTCATTGGCAGGTTGTTCTAATGTGGGGGCCACATTAGA
GC/TTAGA
CCTCTCTCGGAGACAGGCTGTACATGGCCAGCCAGCATTCTGGTAATATGAGCCAAATG
CCCATTGACCTAATTTTGGAGAAGAGGTTTATCAACATGTC
Celera SNP ID: hDV79877074
Public SNP ID: rs17860508
SNP Chromosome Position: 158692783
SNP in Genomic Sequence: SEQ ID NO: 18
SNP Position Genomic: 19450
SNP Source: dbSNP
Population (Allele, Count): no_pop (GC, —|TTAGA, —)
SNP Type: INTRONIC INDEL Context (SEQ ID NO: 270):
TTATCAATTCTTCATTTCATGGATTGTGTCTTTGGTGTTATATCTAAAAAGTCATCACCA
AACGCTAGATCATCTAGATTTTATTCTATGTTATGATCTAR
GAGTTTTATAGGTTCACATTTTATATTTAGGTCTGTGAATTAGTTTTTGTGAAAACTGTA
AGGTCTGTGTCTAGTTGATGTTCAGTTATTCTAATATCAT
Celera SNP ID: hCV7538744
Public SNP ID: rs1422880
SNP Chromosome Position: 158748197
SNP in Genomic Sequence: SEQ ID NO: 18
SNP Position Genomic: 74864
Related Interrogated SNP: hCV11314640 (Power = .51)
SNP Source: dbSNP; Celera; HapMap; HGBASE
Population (Allele, Count): Caucasian (G, 112|A, 8)
SNP Type: INTERGENIC; UNKNOWN Context (SEQ ID NO: 271):
TAATACATATAATACAGAAAATATCTGTTAATTGGCTATACTATTCATAAGGCTTCCAGT
CAATAGAAGGCTGTTATTAGTTAAGTTCTGGCTGAGTCAAR
AGTGATACATAAATTTTCAACTGCATGGTGGGGTCAACATTACTAAACCCCTCACCCTT
CATGGGTGAACTGTATTTTTATATCTATATCTAATCTATAT
Celera SNP ID: hCV7538751
Public SNP ID: rs1422879
SNP Chromosome Position: 158751276
SNP in Genomic Sequence: SEQ ID NO: 18
SNP Position Genomic: 77943
Related Interrogated SNP: hCV11314640 (Power = .51)
```

TABLE 2-continued

```
SNP Source: dbSNP; Celera; HapMap; HGBASE
Population (Allele, Count): Caucasian (A, 111|G, 7)
SNP Type: INTERGENIC; UNKNOWN Context (SEQ ID NO: 272):
ACTGAGGACAAACTAGGGAGTGGTGGGGACCACAGTGAACCCATGGCGCATGCTCTTT
CCCAGAGGCAGGTCGCTCCTCAGATCCAGCTGACTGTGCCAGM
TGTGAAAGCAAGATGGGCATCACAGTTCTTGTGATGTTTAGAGAAGAGCTGGAAAACT
GAACTTAAATGTGAAGTAGCTATTTTAAAGGCTGGCCACAAT
Celera SNP ID: hCV7538752
Public SNP ID: rs1363669
SNP Chromosome Position: 158754724
SNP in Genomic Sequence: SEQ ID NO: 18
SNP Position Genomic: 81391
Related Interrogated SNP: hCV11314640 (Power = .51)
SNP Source: dbSNP; Celera; HapMap; HGBASE
Population (Allele, Count): Caucasian (A, 111|C, 7)
SNP Type: INTERGENIC; UNKNOWN Context (SEQ ID NO: 273):
AATATCTGATTGTGTTACTTCCTTGCTGAAAACCCTTCAGTGGGTTTCAGGGCCCGGGGC
CCCCAGAACAAGATTCTGAGTCCTGCAAGCTTGCAAGTCCK
CCATGCTCTGCCTCCTGGCTACCTCTCTCTTTTCTTTGCCTTTCTCTTTAGGAGGCCAGAA
CCCCGGTCTGTTTTCTTTCCTGCAATATCCCTGTGGCCA
Celera SNP ID: hCV15824051
Public SNP ID: rs2853697
SNP Chromosome Position: 158675981
SNP in Genomic Sequence: SEQ ID NO: 18
SNP Position Genomic: 2648
Related Interrogated SNP: hCV15894459 (Power = .51)
Related Interrogated SNP: hCV27467945 (Power = .51)
SNP Source: dbSNP; HapMap; HGBASE
Population (Allele, Count): Caucasian (T, 102|G, 18)
SNP Type: TRANSCRIPTION FACTOR BINDING SITE; INTRON Context (SEQ ID NO: 274):
TGGAGGTTAACATCAATTAACATCAATAAGAGACTTGATGTTAATTCATTACACTCACC
ATGACTTGGCTTTTCAATTTGTTGTTGTTGTTGTTTTTAACY
CTTATGAGCGAAAGAGAAAATTGATACTATCCAAGGGTATAGAATTACCTTTCTGGTCC
TTTAAAATATCAGTGGACCAAATTCCATCTTCCTTTTTGTG
Celera SNP ID: hCV15879826
Public SNP ID: rs2288831
SNP Chromosome Position: 158682591
SNP in Genomic Sequence: SEQ ID NO: 18
SNP Position Genomic: 9258
Related Interrogated SNP: hCV2084270 (Power = .51)
Related Interrogated SNP: hCV2084293 (Power = .51)
Related Interrogated SNP: hDV71045748 (Power = .51)
SNP Source: dbSNP; HapMap; ABI_Val; HGBASE
Population (Allele, Count): Caucasian (T, 91|C, 25)
SNP Type: TRANSCRIPTION FACTOR BINDING SITE; INTRON Context (SEQ ID NO: 275):
TGAAGCAGTCCAGTAGAGCTTAGTCTTCCCATTTAATGAAGAAGCGTACTGAGGCCAAC
GATCTAAGCATGGTCACAGCAAGTCAGAAGTACAAGGGCTAY
AGCTCAGACCTTTTGTCTCTTGGGCTTTGCAAGGGATGCCTAATGCTAGTGTCTAAACTG
GCCTTTGAGGAATGGCTTAGTATAGTATTTCAGAGTGTGT
Celera SNP ID: hCV16044033
Public SNP ID: rs2569254
SNP Chromosome Position: 158683827
SNP in Genomic Sequence: SEQ ID NO: 18
SNP Position Genomic: 10494
Related Interrogated SNP: hCV27467945 (Power = .51)
SNP Source: dbSNP; HapMap; HGBASE
Population (Allele, Count): Caucasian (C, 102|T, 18)
SNP Type: INTRON Context (SEQ ID NO: 276):
AGAGTTCTAATTCACTAAACAAAACCTCAGTATACACCAAAATAGAACCTCCTTAAAGC
ATAAATCTCACATGCCCTGCAAAACAGTAACGCAATGAAAAR
AACAAAGTATCTAGGCAACAACTAACATGATGAATAGAACAGCACCTCACATCTCCAT
ATTAACTTTGAATGTAAATGGCCCAAATGCTCCACTTGAGAG
Celera SNP ID: hCV27106364
Public SNP ID: rs4262088
SNP Chromosome Position: 158738822
SNP in Genomic Sequence: SEQ ID NO: 18
SNP Position Genomic: 65489
```

TABLE 2-continued

```
Related Interrogated SNP: hCV11314640 (Power = .51)
SNP Source: dbSNP; Celera; HapMap
Population (Allele, Count): Caucasian (A, 112|G, 8)
SNP Type: INTERGENIC; UNKNOWN Context (SEQ ID NO: 277):
TTATGTCTTTATGCACTTGGAGAAACATTTCTTTAGTAAGCATTTTCCTTTTAAAGATGA
AAAAGTGAGACCCCAATGCTTAATTTACTCAGTGAAATAAW
GGTAAAGTCAGGATGATCACCTGGGGTTTGCTTCGGTGATGATTAAAGTAAGCCACATG
GGGGTTAACACATAGGTCTTGTATTTATGGAAGTTGCTTTC
Celera SNP ID: hCV32389155
Public SNP ID:
SNP Chromosome Position: 158681347
SNP in Genomic Sequence: SEQ ID NO: 18
SNP Position Genomic: 8014
SNP Source: HGBASE; dbSNP
Population (Allele, Count): no_pop (A, —|T, —)
SNP Type: INTRON Context (SEQ ID NO: 278):
TACCTCCCAACAGTCCTGTGAATTTACTATGCTACCCCAGGGTGACCTGGTAGAGAGTT
TGGAACCACAGCTAGCCATAGTACTTTCAAACTACTAAAGTY
AGATATCTCTTTGCCACCAAATCCCTCCTCAGGGCCATATGTGACCCTGCATTTTGTGCA
GGGATTCCAGGAAGCAAAGTTGTCACTCTTTCTGGAAACT
Celera SNP ID: hCV31985590
Public SNP ID: rs11738529
SNP Chromosome Position: 158702844
SNP in Genomic Sequence: SEQ ID NO: 18
SNP Position Genomic: 29511
Related Interrogated SNP: hCV30611467 (Power = .51)
SNP Source: dbSNP; HapMap
Population (Allele, Count): Caucasian (T, 64|C, 46)
SNP Type: INTRON Context (SEQ ID NO: 279):
AGTGACAATTACATATCAGGCACCCAGCTAAATTCTGTGAATGTAGTAAGCAGATCAGA
CCTGGACTCTGTCCTCATAGAGCTAAATAGATATGTGCAGAR
GACAAAATGCTATGAAGGAAATGAATGGGTGGTGAGACAGAGAATCACAGGGGAGGG
CTCTCTGATGAGGTGGCATTTAAGTTGGGACCTACAGGTGAAC
Celera SNP ID: hDV70836316
Public SNP ID: rs17056705
SNP Chromosome Position: 158701831
SNP in Genomic Sequence: SEQ ID NO: 18
SNP Position Genomic: 28498
Related Interrogated SNP: hCV11314640 (Power = .51)
SNP Source: dbSNP; HapMap
Population (Allele, Count): Caucasian (G, 112|A, 8)
SNP Type: INTRON Context (SEQ ID NO: 280):
CCTGCCAGAAGGCAATTAAAGAGTGGAAGAGCAGAAATGCAGAGAAGGAATTCAACA
CCTGCTCCACCAGCACGTTCCTTGGTCGCTCTCGTCTGTTTCCY
TAGCTGGATCACATTCTTGGTGAATGAGAGAAAGTATGAGGATTAATGAGCAGACCTGT
CTTTGGGATACCCTAGAACCATGATGCAATGCAAATATCAC
Celera SNP ID: hDV70836317
Public SNP ID: rs17056706
SNP Chromosome Position: 158703333
SNP in Genomic Sequence: SEQ ID NO: 18
SNP Position Genomic: 30000
Related Interrogated SNP: hCV30611467 (Power = .51)
SNP Source: dbSNP; HapMap
Population (Allele, Count): Caucasian (C, 69|T, 49)
SNP Type: INTRON Context (SEQ ID NO: 281):
GGATGAGTCTCACTTAGTCATGAAATGCAGTCTCTTTGTATGTTGCTGGATTTAGTTTGC
TAGTACTTTGTTGAGAATTTGTGCCTCCATATTCTTAAGTR
ATTTTGGTCTGCAGTTTTTTTTTTGAGATGTGTTTGTCTGGTTTTGATATCAGGGTAATAC
TAATTTCATAGAATAAGTTAAGAAGTGTTTCCTCCTCTT
Celera SNP ID: hCV31985588
Public SNP ID: rs6878967
SNP Chromosome Position: 158711610
SNP in Genomic Sequence: SEQ ID NO: 18
SNP Position Genomic: 38277
Related Interrogated SNP: hCV30611467 (Power = .51)
SNP Source: dbSNP; HapMap; ABI_Val
Population (Allele, Count): Caucasian (A, 71|G, 49)
SNP Type: INTRON
Gene Number: 7
Gene Symbol: Chr1: 67490910..67543062
```

TABLE 2-continued

Gene Name:
Chromosome: 1
OMIM NUMBER:
OMIM Information:
Genomic Sequence (SEQ ID NO: 19)
SNP Information Context (SEQ ID NO: 282):
TCTGGCAAAGAGAAGGCCACACACCAGGAAGCCCCTGAGGGTACAGGGACATTACTGA
TTATAAAGGAGGGAAGGAACAAGCTATGTGTGTTCCTGATAAM
CCCTGGCCCTCGGGATTGGCTGTCAAGGGGCTCAAAACCCAGTCCAAGGGACAAACAC
ATCATCCAAGCCTTGCAATGCAGTGATGTAAGTGCAATGATA
Celera SNP ID: hCV261080
Public SNP ID: rs10889675
SNP Chromosome Position: 67494804
SNP in Genomic Sequence: SEQ ID NO: 19
SNP Position Genomic: 3894
SNP Source: dbSNP; Celera; HapMap; ABI_Val
Population (Allele, Count): Caucasian (C, 105|A, 15)
SNP Type: INTRON Context (SEQ ID NO: 283):
CAGTGGAAATAAATATTTGATGTTATTTTCAATAAATTGTTACTGGAGTTAAACCTCTTG
CTATCCTGACAATTCCTCCCTACATCACCCTCTTTGCAATR
GCAGATGGAAGAATTGGCAATAAATGCAATTCAGCTTGAAGAAAACACCCTAAATATT
AGAAACCTGTGAAGAACCACCGGATTGCCTTATCAACTCATT
Celera SNP ID: hCV2720238
Public SNP ID: rs11209032
SNP Chromosome Position: 67512680
SNP in Genomic Sequence: SEQ ID NO: 19
SNP Position Genomic: 21770
SNP Source: dbSNP; Celera; HapMap
Population (Allele, Count): Caucasian (G, 83|A, 37)
SNP Type: INTERGENIC; UNKNOWN Context (SEQ ID NO: 284):
GACTAGAAATTGAGGCTATACCTGCAATGGGAGCAATGTACCTGCCTTTGTCCCAACTC
AGGGGAAAAATTCAAGCTGCTTTATCACAATGCAAACTTCGY
GGGGGAGAAAGGGTTTCTTTCTATAATTCTTGTATTCAAGAAGGATTCATTGAACTACT
GAATGTCCTTACTGTTATATGTGCAAGGCCATTTGAAGGAT
Celera SNP ID: hCV2720250
Public SNP ID: rs4655531
SNP Chromosome Position: 67500366
SNP in Genomic Sequence: SEQ ID NO: 19
SNP Position Genomic: 9456
SNP Source: Celera; HGBASE; dbSNP
Population (Allele, Count): no_pop (C, —|T, —)
SNP Type: INTERGENIC; UNKNOWN Context (SEQ ID NO: 285):
GTGCAATCTCGGCTCACTGCAACCTCCATCTCCTGGGTTCAAGTGATTCTCATGCCTCAG
CCTCCCAAGTAGCTAGGAATACAGGCACACACCACCATTTS
CAACTAATTTTTATATTTTTGGTGGAGACGGGATTTCACCATGTTGGCCAGGCTGCTCTT
GAGCTCTTGGCCTCAAGTGATCTGCCTGTCTTTGCCTCCC
Celera SNP ID: hCV8367042
Public SNP ID: rs1008193
SNP Chromosome Position: 67492499
SNP in Genomic Sequence: SEQ ID NO: 19
SNP Position Genomic: 1589
SNP Source: dbSNP; Celera; HapMap; HGBASE
Population (Allele, Count): Caucasian (G, 82|C, 38)
SNP Type: INTRON Context (SEQ ID NO: 286):
TTGAGTATTTCTAAGCTGCTCGATAGATTAGAGTTGTTTGGTGTGGCAGTTCCCCAGTGT
GTCCAGTTGCTCACAAATTTTGACTTGAATGTTCTTTGCCR
AATTGGCACTGAGTTTCTCCTTCTTGCCATCATTTGCTTCATGAAATAATCTTTCTTTCGT
TTACATTTATAATCAAGTGCAGTAGAAAGATTTTAAATG
Celera SNP ID: hCV8367043
Public SNP ID: rs1343151
SNP Chromosome Position: 67491717
SNP in Genomic Sequence: SEQ ID NO: 19
SNP Position Genomic: 807
SNP Source: dbSNP; Celera; HapMap; ABI_Val; HGBASE
Population (Allele, Count): Caucasian (G, 73|A, 47)
SNP Type: TRANSCRIPTION FACTOR BINDING SITE; INTRON Context (SEQ ID NO: 287):
ATCTTGTTTCCAGAGTAGTGACATTTCTGTGCTCCTACCATCACCATGTAAGAATTCCCG
GGAGCTCCATGCCTTTTTAATTTTAGCCATTCTTCTGCCTM TABLE 2-continued

```
ATTTCTTAAAATTAGAGAATTAAGGTCCCGAAGGTGGAACATGCTTCATGGTCACACAT
ACAGGCACAAAAACAGCATTATGTGGACGCCTCATGTATTT
Celera SNP ID: hCV11283764
Public SNP ID: rs10889677
SNP Chromosome Position: 67497708
SNP in Genomic Sequence: SEQ ID NO: 19
SNP Position Genomic: 6798
SNP Source: dbSNP; Celera; HapMap
Population (Allele, Count): Caucasian (C, 87|A, 33)
SNP Type: UTR3

Context (SEQ ID NO: 288):
GACCTTGAACTCCAGGGCTCAAATAATCTGCCCACCTTGGCCTCCCAAAGTGCTAGGAT
TACAGGCATGAGCCAATATGCCCAGCCAAATATCTTAATCAM
CATCATCATCATCATCATAAACTGCCGGTAGGAAGTTTGGCATAATGTGTCACATCAAT
TATAAATCACAGATGATTTTACTTGATATAGTTAGCTAGAG
Celera SNP ID: hCV26465573
Public SNP ID: rs11209030
SNP Chromosome Position: 67510363
SNP in Genomic Sequence: SEQ ID NO: 19
SNP Position Genomic: 19453
SNP Source: dbSNP; Celera; HapMap; ABI_Val
Population (Allele, Count): Caucasian (C, 79|A, 41)
SNP Type: INTERGENIC; UNKNOWN Context (SEQ ID NO: 289):
CAGCCTAAATTTTAGGGCTTTATTATATAACATTCTCTTTTTAAATATGCGGTAGTTACG
GTCACCTTGGAAAGTTCTACAAAATATCCCTTAAGTTTTTY
GAACTTTCCCACATGGGAATCTTCTGGTTATGAGAGTTTGCTCTATTTAATATGTGTACG
GTTTCACTGCTAGGGTGGTTCTCCCACTTATCTTGAATCT
Celera SNP ID: hCV30243123
Public SNP ID: rs6693831
SNP Chromosome Position: 67493455
SNP in Genomic Sequence: SEQ ID NO: 19
SNP Position Genomic: 2545
SNP Source: dbSNP; HapMap
Population (Allele, Count): Caucasian (T, 30|C, 90)
SNP Type: INTRON Context (SEQ ID NO: 290):
GGTTGAAGTATGGTCCACTGGGATTGGCCAAGACTCAGTTACTGTTACAGGCACATACT
CCTAAGTCAGGTTTTCACTCTTGTCTGCCTGTTAAGTTAGGW
TACAGTTCATCCACAGGGATTCAAATATAGAGGTATGAAGTCCTTCTCAGGCCATATTT
AGTTTGCTTTAACACTTGAATTCCACCCAAACAAATCAGCT
Celera SNP ID: hCV31222811
Public SNP ID: rs12085634
SNP Chromosome Position: 67491301
SNP in Genomic Sequence: SEQ ID NO: 19
SNP Position Genomic: 391
SNP Source: dbSNP
Population (Allele, Count): no_pop (A, —|T, —)
SNP Type: INTRON Context (SEQ ID NO: 291):
AATTAGGCCTGCGAAAGAGACAGACTCCTTCCAGTGACAGAGTGTTAGGTGGCAAGTTC
AGAAGCTGTCAGTCTTGTTTTTCTCCATGTGGCCAGAATGAM
AGGAAGATGGCCCATAGACGCAGAATAAGAAGAATAATAAACAGATCCACAGAAAAG
GACAGAGGAGAGATGAAATGAGAACCCTGAATGCATTAGAATC
Celera SNP ID: hCV31222784
Public SNP ID: rs11209031
SNP Chromosome Position: 67512176
SNP in Genomic Sequence: SEQ ID NO: 19
SNP Position Genomic: 21266
SNP Source: dbSNP; HapMap
Population (Allele, Count): Caucasian (A, 76|C, 40)
SNP Type: INTERGENIC; UNKNOWN Context (SEQ ID NO: 292):
GAGGAGTTGCCATCTATTAATACTTATTTTCCACAAAATATTTTGGAAAGCCACTTCAAT
AGGATTTCACTCTTGGAAAAGTAGAGCTGTGTGGTCAAAAK
CAATATGAGAAAGCTGCCTTGCAATCTGAACTTGGGTTTTCCCTGCAATAGAAATTGAA
TTCTGCCTCTTTTTGAAAAAAATGTATTCACATACAAATCT
Celera SNP ID: hCV31222798
Public SNP ID: rs11465827
SNP Chromosome Position: 67497416
SNP in Genomic Sequence: SEQ ID NO: 19
SNP Position Genomic: 6506
SNP Source: dbSNP
Population (Allele, Count): Caucasian (T, 117|G, 3)
SNP Type: MICRORNA; UTR3
```

TABLE 2-continued

Context (SEQ ID NO: 293):
GGCCTCCCCAGCCATATGGAACTGTAAGTCCATTAAATCTCTTTTTTTTGCAAATTGCCC
AGTCTTGGGTATGTCTTTACCAGCAGCGTGAAAATGGACTW
ATACAGCATTTACCACAGTGTCTGGCTCATAGTAACTGTGGCAGAGCCTGCTAATTGTC
CGTTCAACTTCCGTTCTCAAATTCTTACTTCCTAACAGAAC
Celera SNP ID: hCV31222786
Public SNP ID: rs1857292
SNP Chromosome Position: 67510910
SNP in Genomic Sequence: SEQ ID NO: 19
SNP Position Genomic: 20000
SNP Source: dbSNP; HapMap; HGBASE
Population (Allele, Count): Caucasian (T, 10|A, 106)
SNP Type: INTERGENIC; UNKNOWN Context (SEQ ID NO: 294):
TAGAAGTGGCTCTGTTTCAAGCTCTGGTAAGCCTATTAGCTAACTCTTTCCCCAACCTCA
TGTCATCTGAACAAAGGGTTTCTAGGCTAAAAATAAAATAM
TTTTTAAAAGTTCAAAAACAACTGGTCAACAGAATAGAGTCTGAGTTCTGTAACACAAG
ACTTCTGTGATCTGATCCACTCACCATTCCAGCTTTACTCC
Celera SNP ID: hCV261079
Public SNP ID: rs10889676
SNP Chromosome Position: 67495155
SNP in Genomic Sequence: SEQ ID NO: 19
SNP Position Genomic: 4245
Related Interrogated SNP: hCV11283764 (Power = .51)
Related Interrogated SNP: hCV1272302 (Power = .51)
SNP Source: Celera; dbSNP
Population (Allele, Count): no_pop (A, —|C, —)
SNP Type: INTRON Context (SEQ ID NO: 295):
ACATTTTTTTCAATTTCATGGAAAAGAGGTTTTTCATTTTTCCAAAAATTGTACCAAGG
TAAAGCAAAGTTCTAGTTGATGCAGGTGCATTGTATAGGCR
TTAGCAATACTGCCCTCATTATGCACTCATTAGACAGTAGTGCAACCCCAAGAAAAGGA
TGGTTAGATATTCTTTATAGCAATGCAAGAACAGCCTAAC
Celera SNP ID: hCV2720226
Public SNP ID: rs2863209
SNP Chromosome Position: 67505934
SNP in Genomic Sequence: SEQ ID NO: 19
SNP Position Genomic: 15024
Related Interrogated SNP: hCV31222786 (Power = .51)
SNP Source: dbSNP; Celera; HGBASE
Population (Allele, Count): Caucasian (G, 12|A, 106)
SNP Type: INTERGENIC; UNKNOWN Context (SEQ ID NO: 296):
TTTATAAACAGCTAATCGGAACCTCTATTTGTCATAGGCTTTTGAGTTTATTGTTGGGAC
CCATAATAGGACCATTTTTTCTTTTTGTCTTCAAAATTATY
GTAGGCCAGGTGCAGTGGCTTACACCTGTAATCCCAGCACTTCGGGAGGCTGAGGCGG
GTGGATCAAGTGAGGTCAGGAGTTCAAAACCAGCCTGGCCAA
Celera SNP ID: hCV2720231
Public SNP ID: rs11209034
SNP Chromosome Position: 67517272
SNP in Genomic Sequence: SEQ ID NO: 19
SNP Position Genomic: 26362
Related Interrogated SNP: hCV2720238 (Power = .51)
SNP Source: dbSNP; Celera
Population (Allele, Count): Caucasian (T, 37|C, 83)
SNP Type: INTERGENIC; UNKNOWN Context (SEQ ID NO: 297):
AGCCAGTTAATGTCTTTAACAATAAGTGTTAAGGAGCAGCTGCTGCACTTGGATAACAA
GTAATTCAAGGCGCCCACTTAACAGAAATGTTAAACTATAAS
AAGAACCATCTGAGGATTAACAGAAACTTTTTTTTTGTAGATTTCAAGGGAACTTGCCTT
TCAGAATAATAGTACCTAAAGTATTTATAAACAGCTAATC
Celera SNP ID: hCV2720233
Public SNP ID: rs11209033
SNP Chromosome Position: 67517088
SNP in Genomic Sequence: SEQ ID NO: 19
SNP Position Genomic: 26178
Related Interrogated SNP: hCV2720238 (Power = .51)
SNP Source: dbSNP; Celera; HapMap; ABI_Val
Population (Allele, Count): Caucasian (C, 83|G, 37)
SNP Type: INTERGENIC; UNKNOWN Context (SEQ ID NO: 298):
ATTGAAAAGAAGCAGAGCAATAGAGATGAGAGGAAAATCTGAAAAGATAATGACACA
ATTTCCCACTTAATTTTCATTAAGTAAGAGATGAAAACTTTAGM
CTCGGCATCAGGAAGTTTGATTTCTTTAATTAATTTTTTTTTGAGTCAGGGTCTCACTCT TABLE 2-continued

```
GTTGCCCAGAGTGAGTGCAGTGGCATGGTCACAGCTCAC
Celera SNP ID: hCV2720251
Public SNP ID: rs11465817
SNP Chromosome Position: 67493685
SNP in Genomic Sequence: SEQ ID NO: 19
SNP Position Genomic: 2775
Related Interrogated SNP: hCV11283764 (Power = .51)
SNP Source: dbSNP; Celera; HapMap
Population (Allele, Count): Caucasian (C, 66|A, 42)
SNP Type: INTRON Context (SEQ ID NO: 299):
AGTCCTGGAAAAACAAGACAGCCTCAGCTCAGTAGTTCCCATACAAATTCCAATGTTTA
GATTGTTTGGCATAACTGGAGTCACATGCTTATCCATGAACY
AAATAATCATCGTTGACAGGAAATATGGTATTCTCATTGGCCAGGTCAAGTCACATGCT
CACCAGAGGGGTGATGGGGAACTAGCTCCACTCTTGCGCGT
Celera SNP ID: hCV3277187
Public SNP ID: rs7546245
SNP Chromosome Position: 67523062
SNP in Genomic Sequence: SEQ ID NO: 19
SNP Position Genomic: 32152
Related Interrogated SNP: hCV2720238 (Power = .51)
SNP Source: dbSNP; Celera
Population (Allele, Count): Caucasian (T, 84|C, 36)
SNP Type: INTERGENIC; UNKNOWN Context (SEQ ID NO: 300):
GAATGGCCTAGGAAAGTTACATTCCAGAAGGAAACATGTTATTACACATAGGAATCGA
TTGGTCCTCCATGAGTACCTACAATTGAATTCTATGTATTAAM
ACCGCAGAAAAACACATACAGATAGAAATATTTTTAATCAAGGACTAGTATCCAAAG
CAAAACAAAGTGGAAATTTGGTAATTATCCTGTGAATTTCTG
Celera SNP ID: hCV3277191
Public SNP ID: rs12119179
SNP Chromosome Position: 67520003
SNP in Genomic Sequence: SEQ ID NO: 19
SNP Position Genomic: 29093
Related Interrogated SNP: hCV2720238 (Power = .51)
SNP Source: dbSNP; Celera
Population (Allele, Count): Caucasian (A, 83|C, 37)
SNP Type: INTERGENIC; UNKNOWN Context (SEQ ID NO: 301):
AACGACTCTTGGTGTCTTCCAGCGCTAATGATTTATAATTAAGTTAGATTTGTAACCTTA
AAATACTTTATAGCATTTACCCTGCTTGTGAGTGTGTATAS
ATTTAACAGAATTCAACAAGCACGTGCTGAGAAAATTCTTTACCCAGGGCATTCAGCTA
CCTACAGTATAGTCAGAGGGAAATAAAACATGGTTTGGAAT
Celera SNP ID: hCV3277193
Public SNP ID: rs12141431
SNP Chromosome Position: 67519611
SNP in Genomic Sequence: SEQ ID NO: 19
SNP Position Genomic: 28701
SNP Source: dbSNP; Celera
Population (Allele, Count): Caucasian (G, 84|C, 36)
SNP Type: INTERGENIC; UNKNOWN Context (SEQ ID NO: 302):
GCTCATGCTTATGAAATTCACTGGTCTTACCATGTTCCCCATCATCCTGAAGAAGCTGGA
TTGATATAATGGTGGAATGGCCTATTGAAGTCACAATTACW
GTGCCAACTAGATGACAATACTTTGCAGGGCTGGGACAAAGTTCTCCAGAAGGCCGGG
TATGCTCTGAATCAGTGTCCAATATGTTACTGTTTCTCCCAA
Celera SNP ID: hCV11283811
Public SNP ID: rs4655536
SNP Chromosome Position: 67530442
SNP in Genomic Sequence: SEQ ID NO: 19
SNP Position Genomic: 39532
Related Interrogated SNP: hCV31222786 (Power = .51)
SNP Source: dbSNP; Celera
Population (Allele, Count): Caucasian (T, 108|A, 12)
SNP Type: INTERGENIC; UNKNOWN Context (SEQ ID NO: 303):
GTAATCTATCACACATGAAAAAAGCTTTTATCAAGCTTAAAGGATTACAGCATTGTTTG
ATCTTCTGCAAATGTTTCCACTGCAGCGAGTGCCTCCTTTTY
GCCCCCTAGAGTGGGAAGGAAGCTGCTTTCTCATTCTGTGGTGTCTTAACCCACATCACT
ATTCAGCACAAAGGAGACACTTCTGATTCTGTCTTTGCCA
Celera SNP ID: hCV11728628
Public SNP ID: rs2000252
SNP Chromosome Position: 67500143
SNP in Genomic Sequence: SEQ ID NO: 19
SNP Position Genomic: 9233
```

TABLE 2-continued

Related Interrogated SNP: hCV8367042 (Power = .51)
SNP Source: Celera; HGBASE; HapMap; dbSNP
Population (Allele, Count): no_pop (C, —|T, —)
SNP Type: INTERGENIC; UNKNOWN Context (SEQ ID NO: 304):
ACTGCAAATCATCTAAGAAGAGAAAAACCCCTCTGAATTACATGACTGAGTTTCAGAAT
GTGAGTAAAGTATGGCTAACCAAAATGTTCAAGCAAACTGAW
GCAAATTTCCTTTTCTATGACTGTGTAAGCAAAACTCTTTTGCACGATACTAAGTTTGAT
GTGGTGTAGCATGTAAAAGAGAAAGCACCTTTATCTGTGT
Celera SNP ID: hCV29129920
Public SNP ID: rs6677188
SNP Chromosome Position: 67512991
SNP in Genomic Sequence: SEQ ID NO: 19
SNP Position Genomic: 22081
Related Interrogated SNP: hCV26465573 (Power = .51)
Related Interrogated SNP: hCV31222784 (Power = .51)
SNP Source: dbSNP
Population (Allele, Count): Caucasian (T, 80|A, 40)
SNP Type: INTERGENIC; UNKNOWN Context (SEQ ID NO: 305):
TTTGCAATTCTAGAATCGGACAACACCTCATACTATAAAACAGAGTGAGTGTTCTGATG
AGCTGAGCAGAGGAGGTTGATTTAAGGAACTTTCTTATCACR
CTGGCGAAAACTGGCCTGTTTAGGGATTTGGCTGTTATCTCTGTGTCCTGATTTGTTGAA
AGGTCAGATAAAGATCTTAGTTTCAGCAGGTTAGTGTGGA
Celera SNP ID: hCV30423493
Public SNP ID: rs7539328
SNP Chromosome Position: 67505191
SNP in Genomic Sequence: SEQ ID NO: 19
SNP Position Genomic: 14281
Related Interrogated SNP: hCV31222784 (Power = .51)
SNP Source: dbSNP; HapMap
Population (Allele, Count): Caucasian (G, 76|A, 42)
SNP Type: INTERGENIC; UNKNOWN Context (SEQ ID NO: 306):
TCTCTTTTTTTGCAAATTGCCCAGTCTTGGGTATGTCTTTACCAGCAGCGTGAAAATGG
ACTTATACAGCATTTACCACAGTGTCTGGCTCATAGTAACW
GTGGCAGAGCCTGCTAATTGTCCGTTCAACTTCCGTTCTCAAATTCTTACTTCCTAACAG
AACCCCTATGTCATTGATGATAGCAGTTCTCTCAGTGAAA
Celera SNP ID: hCV31222785
Public SNP ID: rs12045232
SNP Chromosome Position: 67510947
SNP in Genomic Sequence: SEQ ID NO: 19
SNP Position Genomic: 20037
Related Interrogated SNP: hCV26465573 (Power = .51)
Related Interrogated SNP: hCV31222784 (Power = .51)
SNP Source: dbSNP; HapMap
Population (Allele, Count): Caucasian (T, 80|A, 40)
SNP Type: INTERGENIC; UNKNOWN
Gene Number: 8
Gene Symbol: Chr5: 158452593..158472593
Gene Name:
Chromosome: 5
OMIM NUMBER:
OMIM Information:
Genomic Sequence (SEQ ID NO: 20)
SNP Information Context (SEQ ID NO: 307):
ATTTCCTTTGGCTGTGCAGAGGCAGCACATACCTCACCTGGGGTGGTGAGTGTGCTTTAT
TTTAATCAAGCCGAGTGTATTCATAGCTTTTCTTCTTGGTR
TCCTTGTGCTTTCAGTCTGGCTTTCTCATCCTGTAATAAATGTTTAAGTAGGAAGGAGGC
TAAAGAGAAGGTGGAAGAGAGACAGAGTGAGTGACAGAAA
Celera SNP ID: hCV1992722
Public SNP ID: rs7732511
SNP Chromosome Position: 158462593
SNP in Genomic Sequence: SEQ ID NO: 20
SNP Position Genomic: 10000
SNP Source: dbSNP; Celera; HapMap
Population (Allele, Count): Caucasian (G, 101|A, 19)
SNP Type: INTRON

TABLE 3

| Marker | Alleles | Primer 1 (Allele-Specific Primer) | Primer 2 (Allele-Specific Primer) | Common Primer |
|---|---|---|---|---|
| hCV11264637 | A/G | CCAAAACCAGACAAGGACAT (SEQ ID NO: 308) | CCAAAACCAGACAAGGACAC (SEQ ID NO: 309) | GCTGCAATGCCTGGTGAGTATTAT (SEQ ID NO: 310) |
| hCV11269323 | A/G | GGGTTGTCCATGACCTCTA (SEQ ID NO: 311) | GGTTGTCCATGACCTCTG (SEQ ID NO: 312) | CCACTGAGCGGGTAAACACTTAG (SEQ ID NO: 313) |
| hCV11283754 | A/G | GGGCACTCTGAATTATCAATCAATTA (SEQ ID NO: 314) | GGCACTCTGAATTATCAATCAATTG (SEQ ID NO: 315) | TCAAGGTGTAGGTAGGTCTGTGTA (SEQ ID NO: 316) |
| hCV11283764 | A/C | AATTTTAGCCATTCTTCTGCCTA (SEQ ID NO: 317) | TTTTAGCCATTCTTCTGCCTC (SEQ ID NO: 318) | AAATACATGAGGCGTCCACATAATGC (SEQ ID NO: 319) |
| hCV11314640 | C/T | GGCCCTGACTGATTTCATG (SEQ ID NO: 320) | TGGCCCTGACTGATTTCATA (SEQ ID NO: 321) | GGTGGCCTCAGCTTCCTT (SEQ ID NO: 322) |
| hCV1272298 | A/G | TGCAAAAACCTACCCAGTTT (SEQ ID NO: 323) | TGCAAAAACCTACCCAGTTC (SEQ ID NO: 324) | TTCATTAGACAACAGAGGAGACAT (SEQ ID NO: 325) |
| hCV1272302 | A/G | TAATAGGAAACTAATATAGAAGATGATGACT (SEQ ID NO: 326) | TAGGAAACTAATATAGAAGATGATGACC (SEQ ID NO: 327) | ATGTTTGCCAAGTTGGTCTTGAACT (SEQ ID NO: 328) |
| hCV15803290 | A/G | CTCTCCCTGGGGATGAA (SEQ ID NO: 329) | CTCTCCCTGGGGATGAG (SEQ ID NO: 330) | CAATTGACTGTAACTGCTCCAAGACA (SEQ ID NO: 331) |
| hCV15894459 | A/G | ATTGCCTTTCCCAACAAGT (SEQ ID NO: 332) | TGCCTTTCCCAACAAGC (SEQ ID NO: 333) | AATTTTGGTCCCACCGCTCATT (SEQ ID NO: 334) |
| hCV1992693 | A/G | CGGCCATGGTTCTAAGAAA (SEQ ID NO: 335) | CGGCCATGGTTCTAAGAAG (SEQ ID NO: 336) | GAAATGTGGGCTGAGGGATAG (SEQ ID NO: 337) |
| hCV1994965 | A/G | TTACTTCCTACATTTACAACCTAGAAT (SEQ ID NO: 338) | ACTTCCTACATTTACAACCTAGAAC (SEQ ID NO: 339) | GAGGAGACCTCAAAGCAGAACCTTA (SEQ ID NO: 340) |
| hCV1994966 | C/T | CTCCTTAAGAAGAGAGATCAACAAG (SEQ ID NO: 341) | CTCCTTAAGAAGAGAGATCAACAAA (SEQ ID NO: 342) | TGGTCTCAATCTCCTGACCTTGTG (SEQ ID NO: 343) |
| hCV1994967 | C/G | CTGGGAATCAGATGATTGAGC (SEQ ID NO: 344) | CTGGGAATCAGATGATTGAGG (SEQ ID NO: 345) | GTGTAAATCTGCCAATTAGCCATCTCT (SEQ ID NO: 346) |
| hCV1994973 | A/G | GCTCTACCTTTATGCACTGTTTTA (SEQ ID NO: 347) | CTCTACCTTTATGCACTGTTTTG (SEQ ID NO: 348) | GTCACAATGAAATACTAGTCAGGACTCTCA (SEQ ID NO: 349) |
| hCV1994974 | C/T | GCAGTGGAGTTATTAGAAGTTATTTAGATG (SEQ ID NO: 350) | GCAGTGGAGTTATTAGAAGTTATTTAGATA (SEQ ID NO: 351) | GTGCCCTGTGGGGTTAAACA (SEQ ID NO: 352) |
| hCV1994990 | C/G | GATGCAACTTTAGAGGCATTTG (SEQ ID NO: 353) | GATGCAACTTTAGAGGCATTTC (SEQ ID NO: 354) | TTAGGACTGGAAACCACGAAGTCAA (SEQ ID NO: 355) |
| hCV1994992 | C/G | GATCAAAGATGTAAATCCAGACTATTG (SEQ ID NO: 356) | GATCAAAGATGTAAATCCAGACTATTC (SEQ ID NO: 357) | CCTCTGTGTTCACACTGATATCAATACCT (SEQ ID NO: 358) |
| hCV1995017 | C/T | TGGCAGCCTCATAATATTTCAAC (SEQ ID NO: 359) | TGGCAGCCTCATAATATTTCAAT (SEQ ID NO: 360) | CAAAGGAACTCCTCTTGTGACATCT (SEQ ID NO: 361) |
| hCV2081970 | C/T | AATTAACTTTAGAATCAGACTTGATACAG (SEQ ID NO: 362) | AAATTAACTTTAGAATCAGACTTGATACAA (SEQ ID NO: 363) | CAGCCCAGGAGTTGGACAAG (SEQ ID NO: 364) |
| hCV2081982 | A/G | TTCGATCAGGCAGTAGGATAT (SEQ ID NO: 365) | TCGATCAGGCAGTAGGATAC (SEQ ID NO: 366) | CATTTGTTGGTTACTAACAGCACTGAA (SEQ ID NO: 367) |
| hCV2084270 | A/G | CAACCAAGAAATAGTCATTTACAGAA (SEQ ID NO: 368) | CAACCAAGAAATAGTCATTTACAGAG (SEQ ID NO: 369) | ATCAGGAGCTGGAGGAAACTTCT (SEQ ID NO: 370) |
| hCV2084281 | C/T | GGGGTGCTGTGTTTCTTTC (SEQ ID NO: 371) | GGGGTGCTGTGTTTCTTTT (SEQ ID NO: 372) | CTAACAGCTGTAATGAGGTATAGTTCACATACTC (SEQ ID NO: 373) |
| hCV2084293 | G/T | CAATGAGCATTTAGCATCG (SEQ ID NO: 374) | TTCAATGAGCATTTAGCATCT (SEQ ID NO: 375) | TGGAGGAAAAGTGGAAGATATTA (SEQ ID NO: 376) |
| hCV2084294 | C/T | ATTTTCATCCTGGATCAGAAC (SEQ ID NO: 377) | ATTTTCATCCTGGATCAGAAT (SEQ ID NO: 378) | AGTTGCCCAGGATCATATGT (SEQ ID NO: 379) |
| hCV2084295 | C/T | GCTAAAGACTTGCTAAGAGTTTG (SEQ ID NO: 380) | TGCTAAAGACTTGCTAAGAGTTTA (SEQ ID NO: 381) | TGTGTAACTTCAGGAAAATGTCTTA (SEQ ID NO: 382) |
| hCV2084296 | C/T | GGAATTCTGCTGTAAGGC (SEQ ID NO: 383) | AAGGAATTCTGCTGTAAGGT (SEQ ID NO: 384) | CTCCTGGCTGTTCCAGATAT (SEQ ID NO: 385) |

TABLE 3-continued

| Marker | Alleles | Primer 1 (Allele-Specific Primer) | Primer 2 (Allele-Specific Primer) | Common Primer |
|---|---|---|---|---|
| hCV2084297 | A/C | ACTAGGAACTCTCTCCCCAAT (SEQ ID NO: 386) | CTAGGAACTCTCTCCCCAAG (SEQ ID NO: 387) | TGTTGTCCCCTCTGACTCTC (SEQ ID NO: 388) |
| hCV2084298 | G/T | GCACCAAAGAAAGGGATAAAC (SEQ ID NO: 389) | GCACCAAAGAAAGGGATAAAA (SEQ ID NO: 390) | CCTCATCGAGTTTTGGAGTCT (SEQ ID NO: 391) |
| hCV2084301 | C/T | CACAGTAAATTCGGTGTTAGTTATC (SEQ ID NO: 392) | CACAGTAAATTCGGTGTTAGTTATT (SEQ ID NO: 393) | TCCACTGGTGATTTAAAACAGA (SEQ ID NO: 394) |
| hCV261080 | A/C | CAAGCTATGTGTTCCTGATAAA (SEQ ID NO: 395) | AAGCTATGTGTTCCTGATAAC (SEQ ID NO: 396) | CACATGTTGGGCTCATTTCTATCA (SEQ ID NO: 397) |
| hCV26465573 | A/C | GCCCAGCCAAATATCTTAATCAA (SEQ ID NO: 398) | GCCCAGCCAAATATCTTAATCAC (SEQ ID NO: 399) | CCCCTGTGGATTATCTCTAGCTAACT (SEQ ID NO: 400) |
| hCV27106358 | A/C | GGTGGGGTCAACATTACTAAA (SEQ ID NO: 401) | GGTGGGGTCAACATTACTAAC (SEQ ID NO: 402) | GCTGAGGCCACCCAAACTAAATA (SEQ ID NO: 403) |
| hCV27106365 | G/T | GAGAATGAGATAAGCCTCAAGAG (SEQ ID NO: 404) | AGAGAATGAGATAAGCCTCAAGAT (SEQ ID NO: 405) | CATAGAGAGTCTTTGTGCTCTGGTTGTA (SEQ ID NO: 406) |
| hCV27106385 | A/G | TCACACTGTCAGACACATCT (SEQ ID NO: 407) | CACACTGTCAGACACATCC (SEQ ID NO: 408) | AAGGGGCTTCTTGAGAGGAAATGA (SEQ ID NO: 409) |
| hCV2720238 | A/G | CTACATCACCCTCTTTGCAATA (SEQ ID NO: 410) | ACATCACCCTCTTTGCAATG (SEQ ID NO: 411) | CGGTGGTTCTTCACAGGTTTCTAATA (SEQ ID NO: 412) |
| hCV2720250 | C/T | TTTATCACAATGCAAACTTCGC (SEQ ID NO: 413) | CTTTATCACAATGCAAACTTCGT (SEQ ID NO: 414) | CTGCAGGGATTGACTGGTTTTGTTA (SEQ ID NO: 415) |
| hCV2720255 | G/T | AGCTTTTGCAAGCTCAAAATTAC (SEQ ID NO: 416) | AGCTTTTGCAAGCTCAAAATTAA (SEQ ID NO: 417) | CAGGCCACCACTGTGAAAGTAA (SEQ ID NO: 418) |
| hCV27467945 | A/G | AGTGCTTTTGCGACATGAT (SEQ ID NO: 419) | GTGCTTTTGCGACATGAC (SEQ ID NO: 420) | AGGACAGTCCTGGAGACTATCTTTAAGA (SEQ ID NO: 421) |
| hCV27471935 | C/G | GCTTTGTCAGAACTGCTACTAAC (SEQ ID NO: 422) | GCTTTGTCAGAACTGCTACTAAG (SEQ ID NO: 423) | CAGTGTCCAAGAAGGCTTGACTT (SEQ ID NO: 424) |
| hCV27508808 | A/C | ACAACAGACGGCTGAGTA (SEQ ID NO: 425) | CAACAGACGGCTGAGTC (SEQ ID NO: 426) | AGTGGTTCTCAAGGTGTGGTCTTA (SEQ ID NO: 427) |
| hCV27936085 | C/T | GCTGTTGTCCTCATTATACAAATGG (SEQ ID NO: 428) | GCTGTTGTCCTCATTATACAAATGA (SEQ ID NO: 429) | CTCCCGTTAATTCCCAAAGTGTTACTT (SEQ ID NO: 430) |
| hCV27952715 | A/G | TGGGCAATCATATCCACTCT (SEQ ID NO: 431) | GGGCAATCATATCCACTCC (SEQ ID NO: 432) | GCCCTTTGCCAAGCGATACT (SEQ ID NO: 433) |
| hCV28024675 | C/T | GCTGACTGAACCACAGG (SEQ ID NO: 434) | AGCTGACTGAACCACAGA (SEQ ID NO: 435) | GAAGTGGGCGGCAGAGAA (SEQ ID NO: 436) |
| hCV29349404 | A/C | AGTCTATGTTATCAGGCCACTAAT (SEQ ID NO: 437) | GTCTATGTTATCAGGCCACTAAG (SEQ ID NO: 438) | GATGCTGTGGTCTGAACGTTTATGT (SEQ ID NO: 439) |
| hCV29349406 | G/T | CTTCCTCATGCCCAAAGG (SEQ ID NO: 440) | TCTTCCTCATGCCCAAAGT (SEQ ID NO: 441) | GAGGTGACAGCGATTAGGGAGTAG (SEQ ID NO: 442) |
| hCV29619986 | C/T | GCCCTTCTCAGTGAATCTCG (SEQ ID NO: 443) | GCCCTTCTCAGTGAATCTCA (SEQ ID NO: 444) | CTGGTGGACAGACACAACCTAAAC (SEQ ID NO: 445) |
| hCV2989999 | A/C | TGATAAGAGGCAGAGTTTAATTCAA (SEQ ID NO: 446) | TGATAAGAGGCAGAGTTTAATTCAC (SEQ ID NO: 447) | CACACACCCTTGGGCATTAATTAGT (SEQ ID NO: 448) |
| hCV2990018 | C/T | CAGCCTTGGAGTTCACC (SEQ ID NO: 449) | GCAGCCTTGGAGTTCACT (SEQ ID NO: 450) | TGTGCTCAGCAGAAAAGATATAT (SEQ ID NO: 451) |
| hCV29927086 | C/T | CAGGGTGTCGAGAACAAC (SEQ ID NO: 452) | TCAGGGTGTCGAGAACAAT (SEQ ID NO: 453) | CTCAGTCAAATGTAAGGCAGATACTGT (SEQ ID NO: 454) |
| hCV30243123 | C/T | CCCATGTGGGAAAGTTCG (SEQ ID NO: 455) | TCCCATGTGGGAAAGTTCA (SEQ ID NO: 456) | CTCAGAACAGCCTAAATTTTAGGCTTTAT (SEQ ID NO: 457) |
| hCV30279129 | C/T | GCGCTAATTACACTACCAAATG (SEQ ID NO: 458) | GTAGCGCTAATTACACTACCAAATA (SEQ ID NO: 459) | GAACTCTATAACTGCCTAGCAAGATTATGC (SEQ ID NO: 460) |

TABLE 3-continued

| Marker | Alleles | Primer 1 (Allele-Specific Primer) | Primer 2 (Allele-Specific Primer) | Common Primer |
|---|---|---|---|---|
| hCV30377542 | G/T | CAATGGCAAAGCTGTTAGTG (SEQ ID NO: 461) | ACAATGGCAAAGCTGTTAGTT (SEQ ID NO: 462) | GCTGGGATTATAGGTGTGCACTACT (SEQ ID NO: 463) |
| hCV30449508 | A/C | ACTGCTTCTAGCCCAGTT (SEQ ID NO: 464) | ACTGCTTCTAGCCCAGTG (SEQ ID NO: 465) | ACCTAAGGCAAGCCATCTGATACA (SEQ ID NO: 466) |
| hCV30611467 | C/T | TCTACCAATCAATAAGGTAAGACAG (SEQ ID NO: 467) | CTTCTACCAATCAATAAGGTAAGACAA (SEQ ID NO: 468) | GCCAGGCACCTTCTCAGTCTAT (SEQ ID NO: 469) |
| hCV31222784 | A/C | TCCATGTGGCCAGAATGAA (SEQ ID NO: 470) | CCATGTGGCCAGAATGAC (SEQ ID NO: 471) | GCATTCAGGGTTCTCATTTCATCTCT (SEQ ID NO: 472) |
| hCV31222786 | A/T | ACACTGTGGTAAATGCTGTATT (SEQ ID NO: 473) | GACACTGTGGTAAATGCTGTATA (SEQ ID NO: 474) | CCCAGCCATATGGAACTGTAAGT (SEQ ID NO: 475) |
| hCV31222798 | G/T | AGGCAGCTTTCTCATATTGC (SEQ ID NO: 476) | CAAGGCAGCTTTCTCATATTGA (SEQ ID NO: 477) | ATCGTGAATGAGGAGTTGCCATCTA (SEQ ID NO: 478) |
| hCV31222811 | A/T | TCCCTGTGGATGAACTGTAT (SEQ ID NO: 479) | TCCCTGTGGATGAACTGTAA (SEQ ID NO: 480) | GATTGGCCAAGACTCAGTTACTGTT (SEQ ID NO: 481) |
| hCV31222825 | A/G | GGGAAGCAAAATTAACCTTTACT (SEQ ID NO: 482) | GGGAAGCAAAATTAACCTTTACC (SEQ ID NO: 483) | CACATTTGCCAGAGATGCACTTCTA (SEQ ID NO: 484) |
| hCV31222826 | C/T | TGAAGCTCACCACTAAGAATTTATAC (SEQ ID NO: 485) | TGAAGCTCACCACTAAGAATTTATAT (SEQ ID NO: 486) | CACAACTACCCCAGGAAACAACT (SEQ ID NO: 487) |
| hCV31222838 | G/T | GATGGGTTAAAATGGGCAATTC (SEQ ID NO: 488) | TGATGGGTTAAAATGGGCAATTA (SEQ ID NO: 489) | GCTAACAGTTGCTTCCATCTCTACA (SEQ ID NO: 490) |
| hCV3169817 | A/G | TGTATGAAGTGCTGAGGATAAATAA (SEQ ID NO: 491) | TGTATGAAGTGCTGAGGATAAATAG (SEQ ID NO: 492) | ATTTCCCCCACCAACACACATAC (SEQ ID NO: 493) |
| hCV31985582 | A/G | CTAATAAATAATGAATATGCTGCACCA (SEQ ID NO: 494) | ATAAATAATGAATATGCTGCACCG (SEQ ID NO: 495) | GCTTCCAGCTCCATCCAAGTTG (SEQ ID NO: 496) |
| hCV31985592 | C/T | TCACCAGGTCACTGCC (SEQ ID NO: 497) | TTCACCAGGTCACTGCT (SEQ ID NO: 498) | GCAGTTTTCTGCCTCCAGGAAATAC (SEQ ID NO: 499) |
| hCV31985602 | G/T | TTTTTGCGGCAGATGAC (SEQ ID NO: 500) | TTTTTGCGGCAGATGAA (SEQ ID NO: 501) | GGCTTGTTTTGGGAGAGTATG (SEQ ID NO: 502) |
| hCV3220380 | C/T | GATGGTCACAGTTATGATTCCC (SEQ ID NO: 503) | GATGGTCACAGTTATGATTCCT (SEQ ID NO: 504) | CCTGGGTGACAGAATGAGACTC (SEQ ID NO: 505) |
| hCV3220386 | C/T | CTCCCACGGCTTGTAATC (SEQ ID NO: 506) | CTCCCACGGCTTGTAATT (SEQ ID NO: 507) | GCACATTTAGCCAATTTCAACACATAT (SEQ ID NO: 508) |
| hCV7537756 | C/G | TGGAGCTCAAATGTTGGTTAG (SEQ ID NO: 509) | TGGAGCTCAAATGTTGGTTAC (SEQ ID NO: 510) | CCTGTTCTTGCAAGGAGGTGATC (SEQ ID NO: 511) |
| hCV7537839 | G/T | CATCTGTCTGCTTCTCACAG (SEQ ID NO: 512) | CATCTGTCTGCTTCTCACAT (SEQ ID NO: 513) | GTCTGGAAGGCAAAAGATC (SEQ ID NO: 514) |
| hCV7537857 | A/C | GGCCAGTCCTCACACAT (SEQ ID NO: 515) | GGCCAGTCCTCACACAG (SEQ ID NO: 516) | AAGACTCCAAGGATAGCGTTAG (SEQ ID NO: 517) |
| hCV7538743 | C/G | TGGACATTTGTTGTGTTTGC (SEQ ID NO: 518) | TTGGACATTTGTTGTGTTTGG (SEQ ID NO: 519) | CCACCCATATCACATGTCATCAGT (SEQ ID NO: 520) |
| hCV7538755 | C/G | TTAGTCATTTAAAGTCAGGTTAATGTTC (SEQ ID NO: 521) | TAGTCATTTAAAGTCAGGTTAATGTTG (SEQ ID NO: 522) | CGGTGTGGCCTTGTGAG (SEQ ID NO: 523) |
| hCV7538761 | C/T | GTGTACCAAATTCATTGCTCTAATC (SEQ ID NO: 524) | GTGTACCAAATTCATTGCTCTAATT (SEQ ID NO: 525) | CAAAGCTTCTTGATGCCTTGTTT (SEQ ID NO: 526) |
| hCV8367042 | C/G | GGCACACACCACCATTTC (SEQ ID NO: 527) | GGCACACACCACCATTTG (SEQ ID NO: 528) | GGCAAAGACAGGCAGATCACT (SEQ ID NO: 529) |
| hCV8367043 | A/G | GGAGAAACTCAGTGCCAATTT (SEQ ID NO: 530) | GGAGAAACTCAGTGCCAATTC (SEQ ID NO: 531) | CATTGAGTATTTCTAAGCTGCTCGATAGA (SEQ ID NO: 532) |
| hDV70267720 | C/T | GGAATGTCATCCAGCCATAAAG (SEQ ID NO: 533) | GGAATGTCATCCAGCCATAAAA (SEQ ID NO: 534) | GCCTTTCGTGTGGGTTCTTTAACT (SEQ ID NO: 535) |

TABLE 3-continued

| Marker | Alleles | Primer 1 (Allele-Specific Primer) | Primer 2 (Allele-Specific Primer) | Common Primer |
|---|---|---|---|---|
| hDV71045748 | A/G | AACTGACGACCAAGACCA (SEQ ID NO: 536) | ACTGACGACCAAGACCG (SEQ ID NO: 537) | TGAGTGGTGCCTGCCTTACTATT (SEQ ID NO: 538) |
| hDV79877074 | C/T | CTGTCTCCGAGAGAGGG (SEQ ID NO: 539) | TCTCCGAGAGAGGCTCAA (SEQ ID NO: 540) | GGGCTGATGCTTGGAGATTGT (SEQ ID NO: 541) |

TABLE 4

| Interrogated SNP | Interrogated rs | LD SNP | LD SNP rs | Power | Threshold $r^2$ | $r^2$ |
|---|---|---|---|---|---|---|
| hCV11283764 | rs10889677 | hCV1272302 | rs2201841 | 0.51 | 0.9 | 0.9325 |
| hCV11283764 | rs10889677 | hCV261079 | rs10889676 | 0.51 | 0.9 | 1 |
| hCV11283764 | rs10889677 | hCV2720251 | rs11465817 | 0.51 | 0.9 | 0.9095 |
| hCV11314640 | rs1833754 | hCV27106364 | rs4262088 | 0.51 | 0.9 | 1 |
| hCV11314640 | rs1833754 | hCV7538744 | rs1422880 | 0.51 | 0.9 | 1 |
| hCV11314640 | rs1833754 | hCV7538751 | rs1422879 | 0.51 | 0.9 | 1 |
| hCV11314640 | rs1833754 | hCV7538752 | rs1363669 | 0.51 | 0.9 | 1 |
| hCV11314640 | rs1833754 | hDV70836316 | rs17056705 | 0.51 | 0.9 | 1 |
| hCV1272302 | rs2201841 | hCV11283764 | rs10889677 | 0.51 | 0.9 | 0.9325 |
| hCV1272302 | rs2201841 | hCV261079 | rs10889676 | 0.51 | 0.9 | 0.9325 |
| hCV15894459 | rs2546892 | hCV15824051 | rs2853697 | 0.51 | 0.9 | 0.9345 |
| hCV15894459 | rs2546892 | hCV27467946 | rs3181226 | 0.51 | 0.9 | 0.9345 |
| hCV1994965 | rs953861 | hCV1994960 | rs4921483 | 0.51 | 0.9 | 1 |
| hCV1994965 | rs953861 | hCV1994973 | rs1157509 | 0.51 | 0.9 | 1 |
| hCV1994965 | rs953861 | hCV1994974 | rs1157510 | 0.51 | 0.9 | 1 |
| hCV1994965 | rs953861 | hCV1994986 | rs11749573 | 0.51 | 0.9 | 1 |
| hCV1994965 | rs953861 | hCV30017148 | rs9313808 | 0.51 | 0.9 | 1 |
| hCV1994965 | rs953861 | hCV7538743 | rs1363670 | 0.51 | 0.9 | 1 |
| hCV1994990 | rs6861600 | hCV11264637 | rs6864071 | 0.51 | 0.9 | 0.9596 |
| hCV1994990 | rs6861600 | hCV11269323 | rs11135059 | 0.51 | 0.9 | 0.9596 |
| hCV1994990 | rs6861600 | hCV1994971 | rs7725339 | 0.51 | 0.9 | 0.9547 |
| hCV1994990 | rs6861600 | hCV27106359 | rs12522665 | 0.51 | 0.9 | 1 |
| hCV1994990 | rs6861600 | hCV27106365 | rs4379175 | 0.51 | 0.9 | 0.9564 |
| hCV1994990 | rs6861600 | hCV29349404 | rs7704367 | 0.51 | 0.9 | 1 |
| hCV1994990 | rs6861600 | hCV31985582 | rs6556412 | 0.51 | 0.9 | 0.9568 |
| hCV2084270 | rs2082412 | hCV15803290 | rs2421047 | 0.51 | 0.9 | 1 |
| hCV2084270 | rs2082412 | hCV15879826 | rs2288831 | 0.51 | 0.9 | 1 |
| hCV2084270 | rs2082412 | hCV2084281 | rs7730390 | 0.51 | 0.9 | 1 |
| hCV2084270 | rs2082412 | hCV2084293 | rs3212227 | 0.51 | 0.9 | 0.9699 |
| hCV2084270 | rs2082412 | hCV27471935 | rs3212217 | 0.51 | 0.9 | 0.9699 |
| hCV2084270 | rs2082412 | hCV27486507 | rs3212219 | 0.51 | 0.9 | 0.9699 |
| hCV2084270 | rs2082412 | hCV27508808 | rs3212218 | 0.51 | 0.9 | 1 |
| hCV2084270 | rs2082412 | hCV27883435 | rs4921442 | 0.51 | 0.9 | 0.9451 |
| hCV2084270 | rs2082412 | hCV29349409 | rs6859018 | 0.51 | 0.9 | 0.9699 |
| hCV2084270 | rs2082412 | hCV29619986 | rs10072923 | 0.51 | 0.9 | 1 |
| hCV2084270 | rs2082412 | hCV29927086 | rs3213094 | 0.51 | 0.9 | 0.9699 |
| hCV2084270 | rs2082412 | hCV30449508 | rs3212220 | 0.51 | 0.9 | 1 |
| hCV2084270 | rs2082412 | hCV30557642 | rs10056599 | 0.51 | 0.9 | 1 |
| hCV2084270 | rs2082412 | hDV71045748 | rs6894567 | 0.51 | 0.9 | 0.9476 |
| hCV2084270 | rs2082412 | hDV75439995 | rs3213097 | 0.51 | 0.9 | 1 |
| hCV2084281 | rs7730390 | hCV15803290 | rs2421047 | 0.51 | 0.9 | 0.9061 |
| hCV2084281 | rs7730390 | hCV2084270 | rs2082412 | 0.51 | 0.9 | 1 |
| hCV2084281 | rs7730390 | hCV2084293 | rs3212227 | 0.51 | 0.9 | 1 |
| hCV2084281 | rs7730390 | hCV27471935 | rs3212217 | 0.51 | 0.9 | 1 |
| hCV2084281 | rs7730390 | hCV27486507 | rs3212219 | 0.51 | 0.9 | 1 |
| hCV2084281 | rs7730390 | hCV27508808 | rs3212218 | 0.51 | 0.9 | 1 |
| hCV2084281 | rs7730390 | hCV29349409 | rs6859018 | 0.51 | 0.9 | 1 |
| hCV2084281 | rs7730390 | hCV29619986 | rs10072923 | 0.51 | 0.9 | 0.9061 |
| hCV2084281 | rs7730390 | hCV29927086 | rs3213094 | 0.51 | 0.9 | 1 |
| hCV2084281 | rs7730390 | hCV30449508 | rs3212220 | 0.51 | 0.9 | 0.9061 |
| hCV2084281 | rs7730390 | hCV30557642 | rs10056599 | 0.51 | 0.9 | 1 |
| hCV2084281 | rs7730390 | hDV75439995 | rs3213097 | 0.51 | 0.9 | 0.905 |
| hCV2084293 | rs3212227 | hCV15803290 | rs2421047 | 0.51 | 0.9 | 1 |
| hCV2084293 | rs3212227 | hCV15879826 | rs2288831 | 0.51 | 0.9 | 1 |
| hCV2084293 | rs3212227 | hCV2084270 | rs2082412 | 0.51 | 0.9 | 0.9699 |
| hCV2084293 | rs3212227 | hCV2084281 | rs7730390 | 0.51 | 0.9 | 1 |
| hCV2084293 | rs3212227 | hCV27471935 | rs3212217 | 0.51 | 0.9 | 1 |
| hCV2084293 | rs3212227 | hCV27486507 | rs3212219 | 0.51 | 0.9 | 1 |
| hCV2084293 | rs3212227 | hCV27508808 | rs3212218 | 0.51 | 0.9 | 1 |
| hCV2084293 | rs3212227 | hCV27883435 | rs4921442 | 0.51 | 0.9 | 0.9451 |
| hCV2084293 | rs3212227 | hCV29349409 | rs6859018 | 0.51 | 0.9 | 1 |
| hCV2084293 | rs3212227 | hCV29619986 | rs10072923 | 0.51 | 0.9 | 1 |

TABLE 4-continued

| Interrogated SNP | Interrogated rs | LD SNP | LD SNP rs | Power | Threshold $r^2$ | $r^2$ |
|---|---|---|---|---|---|---|
| hCV2084293 | rs3212227 | hCV29927086 | rs3213094 | 0.51 | 0.9 | 1 |
| hCV2084293 | rs3212227 | hCV30449508 | rs3212220 | 0.51 | 0.9 | 1 |
| hCV2084293 | rs3212227 | hCV30557642 | rs10056599 | 0.51 | 0.9 | 0.9699 |
| hCV2084293 | rs3212227 | hDV71045748 | rs6894567 | 0.51 | 0.9 | 0.9476 |
| hCV2084293 | rs3212227 | hDV75439995 | rs3213097 | 0.51 | 0.9 | 1 |
| hCV2084294 | rs3213120 | hCV31985602 | rs3213119 | 0.51 | 0.9 | 1 |
| hCV2084296 | rs2853696 | hCV11316602 | rs1865014 | 0.51 | 0.9 | 1 |
| hCV2084296 | rs2853696 | hCV2084251 | rs10515780 | 0.51 | 0.9 | 1 |
| hCV2084296 | rs2853696 | hCV2084252 | rs10866711 | 0.51 | 0.9 | 1 |
| hCV2084296 | rs2853696 | hCV2084259 | rs7708700 | 0.51 | 0.9 | 1 |
| hCV2084296 | rs2853696 | hCV2084263 | rs10515782 | 0.51 | 0.9 | 1 |
| hCV2084296 | rs2853696 | hCV2084265 | rs7736656 | 0.51 | 0.9 | 1 |
| hCV2084296 | rs2853696 | hCV2084266 | rs10042630 | 0.51 | 0.9 | 0.9704 |
| hCV2084296 | rs2853696 | hCV2084274 | rs1433047 | 0.51 | 0.9 | 1 |
| hCV2084296 | rs2853696 | hCV2084277 | rs6874870 | 0.51 | 0.9 | 1 |
| hCV2084296 | rs2853696 | hCV27936085 | rs4921437 | 0.51 | 0.9 | 0.9421 |
| hCV2084296 | rs2853696 | hCV30629526 | rs4921458 | 0.51 | 0.9 | 1 |
| hCV2084296 | rs2853696 | hCV7537839 | rs1368439 | 0.51 | 0.9 | 1 |
| hCV26465573 | rs11209030 | hCV29129920 | rs6677188 | 0.51 | 0.9 | 0.9607 |
| hCV26465573 | rs11209030 | hCV31222784 | rs11209031 | 0.51 | 0.9 | 0.9628 |
| hCV26465573 | rs11209030 | hCV31222785 | rs12045232 | 0.51 | 0.9 | 0.9607 |
| hCV2720238 | rs11209032 | hCV2720231 | rs11209034 | 0.51 | 0.9 | 0.9774 |
| hCV2720238 | rs11209032 | hCV2720233 | rs11209033 | 0.51 | 0.9 | 0.9769 |
| hCV2720238 | rs11209032 | hCV3277187 | rs7546245 | 0.51 | 0.9 | 0.9304 |
| hCV2720238 | rs11209032 | hCV3277191 | rs12119179 | 0.51 | 0.9 | 0.9541 |
| hCV27467945 | rs3181225 | hCV15824051 | rs2853697 | 0.51 | 0.9 | 1 |
| hCV27467945 | rs3181225 | hCV16044033 | rs2569254 | 0.51 | 0.9 | 1 |
| hCV27467945 | rs3181225 | hCV2084260 | rs13153734 | 0.51 | 0.9 | 0.9034 |
| hCV27467945 | rs3181225 | hCV2084282 | rs2099327 | 0.51 | 0.9 | 0.9338 |
| hCV27467945 | rs3181225 | hCV27467946 | rs3181226 | 0.51 | 0.9 | 1 |
| hCV27467945 | rs3181225 | hCV31985611 | rs13161132 | 0.51 | 0.9 | 0.9259 |
| hCV27952715 | rs4655692 | hCV2990015 | rs7528924 | 0.51 | 0.9 | 1 |
| hCV2989999 | rs1343152 | hCV2990001 | rs12030948 | 0.51 | 0.9 | 1 |
| hCV2990018 | rs7530511 | hCV16078411 | rs2863212 | 0.51 | 0.9 | 0.9186 |
| hCV2990018 | rs7530511 | hCV27868367 | rs4655530 | 0.51 | 0.9 | 0.9192 |
| hCV2990018 | rs7530511 | hCV27868368 | rs4655693 | 0.51 | 0.9 | 1 |
| hCV2990018 | rs7530511 | hCV31222825 | rs10889671 | 0.51 | 0.9 | 0.9192 |
| hCV30279129 | rs10489629 | hCV2990017 | rs7518660 | 0.51 | 0.9 | 0.9444 |
| hCV30611467 | rs6869411 | hCV31985588 | rs6878967 | 0.51 | 0.9 | 1 |
| hCV30611467 | rs6869411 | hCV31985590 | rs11738529 | 0.51 | 0.9 | 1 |
| hCV30611467 | rs6869411 | hDV70836317 | rs17056706 | 0.51 | 0.9 | 1 |
| hCV31222784 | rs11209031 | hCV26465573 | rs11209030 | 0.51 | 0.9 | 0.9628 |
| hCV31222784 | rs11209031 | hCV29129920 | rs6677188 | 0.51 | 0.9 | 1 |
| hCV31222784 | rs11209031 | hCV30423493 | rs7539328 | 0.51 | 0.9 | 0.9266 |
| hCV31222784 | rs11209031 | hCV31222785 | rs12045232 | 0.51 | 0.9 | 1 |
| hCV31222786 | rs1857292 | hCV11283811 | rs4655536 | 0.51 | 0.9 | 1 |
| hCV31222786 | rs1857292 | hCV2720226 | rs2863209 | 0.51 | 0.9 | 1 |
| hCV31222825 | rs10889671 | hCV27868367 | rs4655530 | 0.51 | 0.9 | 1 |
| hCV31222825 | rs10889671 | hCV27868368 | rs4655693 | 0.51 | 0.9 | 0.9192 |
| hCV31222825 | rs10889671 | hCV2990018 | rs7530511 | 0.51 | 0.9 | 0.9192 |
| hCV31222826 | rs10789229 | hCV31222830 | rs12751814 | 0.51 | 0.9 | 0.9808 |
| hCV31985602 | rs3213119 | hCV2084294 | rs3213120 | 0.51 | 0.9 | 1 |
| hCV7537756 | rs1368437 | hCV1030157 | rs254837 | 0.51 | 0.9 | 0.9396 |
| hCV7537756 | rs1368437 | hCV25633374 | rs12520035 | 0.51 | 0.9 | 1 |
| hCV7537756 | rs1368437 | hCV28001193 | rs4921466 | 0.51 | 0.9 | 0.9425 |
| hCV7537839 | rs1368439 | hCV11316602 | rs1865014 | 0.51 | 0.9 | 1 |
| hCV7537839 | rs1368439 | hCV2084251 | rs10515780 | 0.51 | 0.9 | 1 |
| hCV7537839 | rs1368439 | hCV2084252 | rs10866711 | 0.51 | 0.9 | 1 |
| hCV7537839 | rs1368439 | hCV2084259 | rs7708700 | 0.51 | 0.9 | 1 |
| hCV7537839 | rs1368439 | hCV2084263 | rs10515782 | 0.51 | 0.9 | 1 |
| hCV7537839 | rs1368439 | hCV2084265 | rs7736656 | 0.51 | 0.9 | 1 |
| hCV7537839 | rs1368439 | hCV2084266 | rs10042630 | 0.51 | 0.9 | 0.9705 |
| hCV7537839 | rs1368439 | hCV2084274 | rs1433047 | 0.51 | 0.9 | 1 |
| hCV7537839 | rs1368439 | hCV2084277 | rs6874870 | 0.51 | 0.9 | 1 |
| hCV7537839 | rs1368439 | hCV2084296 | rs2853696 | 0.51 | 0.9 | 1 |
| hCV7537839 | rs1368439 | hCV27936085 | rs4921437 | 0.51 | 0.9 | 0.9422 |
| hCV7537839 | rs1368439 | hCV30629526 | rs4921458 | 0.51 | 0.9 | 1 |
| hCV8367042 | rs1008193 | hCV11728628 | rs2000252 | 0.51 | 0.9 | 0.9771 |
| hCV8367042 | rs1008193 | hCV29503362 | rs6682033 | 0.51 | 0.9 | 1 |
| hCV8367043 | rs1343151 | hDV81067815 | rs41396545 | 0.51 | 0.9 | 0.9168 |
| hDV71045748 | rs6894567 | hCV15803290 | rs2421047 | 0.51 | 0.9 | 0.9527 |
| hDV71045748 | rs6894567 | hCV15879826 | rs2288831 | 0.51 | 0.9 | 0.9496 |
| hDV71045748 | rs6894567 | hCV2084270 | rs2082412 | 0.51 | 0.9 | 0.9476 |
| hDV71045748 | rs6894567 | hCV2084293 | rs3212227 | 0.51 | 0.9 | 0.9476 |
| hDV71045748 | rs6894567 | hCV27471935 | rs3212217 | 0.51 | 0.9 | 0.9476 |
| hDV71045748 | rs6894567 | hCV27486507 | rs3212219 | 0.51 | 0.9 | 0.9476 |
| hDV71045748 | rs6894567 | hCV27508808 | rs3212218 | 0.51 | 0.9 | 0.9483 |

TABLE 4-continued

| Interrogated SNP | Interrogated rs | LD SNP | LD SNP rs | Power | Threshold $r^2$ | $r^2$ |
|---|---|---|---|---|---|---|
| hDV71045748 | rs6894567 | hCV27883435 | rs4921442 | 0.51 | 0.9 | 0.9026 |
| hDV71045748 | rs6894567 | hCV29349409 | rs6859018 | 0.51 | 0.9 | 0.9476 |
| hDV71045748 | rs6894567 | hCV29619986 | rs10072923 | 0.51 | 0.9 | 0.9527 |
| hDV71045748 | rs6894567 | hCV29927086 | rs3213094 | 0.51 | 0.9 | 0.9476 |
| hDV71045748 | rs6894567 | hCV30449508 | rs3212220 | 0.51 | 0.9 | 0.9527 |
| hDV71045748 | rs6894567 | hCV30557642 | rs10056599 | 0.51 | 0.9 | 0.9476 |
| hDV71045748 | rs6894567 | hDV75439995 | rs3213097 | 0.51 | 0.9 | 0.9523 |

TABLE 5 rs7530511-rs11465804-rs10889671-rs11209026-rs1857292 haplotypes

| Haplotype[a,b] | Sample Set 1 No. (Frequency) in | | Sample Set 2 No. (Frequency) in | | Sample Set 3 No. (Frequency) in | |
|---|---|---|---|---|---|---|
| | Case | Control | Case | Control | Case | Control |
| CTGGA | 754(0.818) | 704(0.769) | 791(0.802) | 747(0.755) | 795(0.828) | 645(0.760) |
| TTAGT | 69(0.075) | 103(0.112) | 68(0.069) | 82(0.083) | 74(0.077) | 78(0.092) |
| CGGAA | 36(0.039) | 47(0.051) | 45(0.046) | 79(0.080) | 33(0.034) | 52(0.061) |
| CTGGT | 31(0.034) | 21(0.023) | 31(0.031) | 36(0.036) | 22(0.023) | 28(0.033) |
| TTAGA | 23(0.025) | 26(0.028) | 20(0.020) | 27(0.027) | 28(0.029) | 31(0.037) |
| Other | 9(0.010) | 15(0.016) | 31(0.031) | 19(0.019) | 8(0.008) | 14(0.017) |

| Haplotype | Sample Set 1 No. (Frequency) in | | | Sample Set 2 No. (Frequency) in | | | Sample Set 3 No. (Frequency) in | | | Combined |
|---|---|---|---|---|---|---|---|---|---|---|
| | Case | Control | OR | Case | Control | OR | Case | Control | OR | $P_{comb}$[d] |
| Protective[c] | 105(0.114) | 150(0.164) | | 113(0.115) | 161(0.163) | | 107(0.112) | 130(0.153) | | |
| All Other | 817(0.886) | 766(0.836) | 0.66 | 873(0.885) | 829(0.837) | 0.67 | 853(0.889) | 718(0.847) | 0.69 | 4.32E-07 |

[a]Haplotype estimates were from the pseudo-Gibbs algorithm in the SNPAnalyzer program.
[b]These haplotypes consist of SNPs: rs7530511, rs11465804, rs10889671, rs11209026 and rs1857292, respectively.
[c]TTAGT and CGGAA haplotypes combined.
[d]Continuity-corrected Mantel-Haenszel P-value.

TABLE 6 rs7530511-rs10889671-rs11209026 haplotypes

| Haplotype[a,b] | Sample Set 1 No. (Frequency) in | | Sample Set 2 No. (Frequency) in | | Sample Set 3 No. (Frequency) in | | Combined |
|---|---|---|---|---|---|---|---|
| | Case | Control | Case | Control | Case | Control | $P_{comb}$[c] |
| CGG | 783(0.852) | 727(0.795) | 830(0.844) | 787(0.798) | 818(0.855) | 677(0.801) | 3.88E-08 |
| TAG | 91(0.099) | 128(0.140) | 88(0.090) | 108(0.110) | 100(0.105) | 107(0.127) | |
| CGA | 39(0.042) | 54(0.059) | 51(0.052) | 86(0.087) | 33(0.035) | 55(0.065) | |
| Other | 6(0.007) | 5(0.006) | 14(0.014) | 5(0.005) | 6(0.006) | 6(0.007) | |

[a]Haplotype estimates were from the pseudo-Gibbs algorithm in the SNPAnalyzer program.
[b]These haplotypes consist of SNPs: rs7530511, rs10889671, and rs11209026, respectively.
[c]Continuity-corrected Mantel-Haenszel P-value for TAG + CGA

TABLE 7

Twenty-three marker haplotypes

| Haplotype[a,b] | Sample Set 1 | | | | Sample Set 2 | | | | Sample Set 3 | | | | Combined Analysis | |
|---|---|---|---|---|---|---|---|---|---|---|---|---|---|---|
| | Case | Control | OR | P[c] | Case | Control | OR | P[c] | Case | Control | OR | P[c] | OR[d] | P[e] |
| CTGGTGCTGGGTGCCCTACCAAA | 248 | 217 | 1.18 | 0.133 | 266 | 252 | 1.07 | 0.506 | 280 | 220 | 1.18 | 0.127 | 1.139 | 0.034 |
| CCGATAACGGTTAGCCTCCAACG | 181 | 184 | 0.97 | 0.815 | 206 | 200 | 1.04 | 0.781 | 215 | 157 | 1.27 | 0.047 | 1.081 | 0.252 |

TABLE 7-continued

Twenty-three marker haplotypes

| Haplotype[a,b] | Sample Set 1 | | | | Sample Set 2 | | | | Sample Set 3 | | | | Combined Analysis | |
|---|---|---|---|---|---|---|---|---|---|---|---|---|---|---|
| | Case | Control | OR | P[c] | Case | Control | OR | P[c] | Case | Control | OR | P[c] | OR[d] | P[e] |
| TTAATGACAGTTGCTCTCCCTAG | 65 | 100 | 0.62 | 0.0042 | 61 | 75 | 0.80 | 0.215 | 73 | 77 | 0.82 | 0.268 | 0.736 | 0.0022 |
| CCGATAATGGTTGCTATCTCAAG | 85 | 76 | 1.12 | 0.510 | 60 | 72 | 0.82 | 0.281 | 65 | 69 | 0.82 | 0.281 | 0.921 | 0.440 |
| CTAATGATGGGAGCCCTCCCAAG | 79 | 62 | 1.28 | 0.162 | 76 | 70 | 1.09 | 0.667 | 75 | 52 | 1.30 | 0.168 | 1.216 | 0.064 |
| CCGAGGCTGATTACCCTCCCAAG | 36 | 47 | 0.75 | 0.217 | 47 | 75 | 0.61 | 0.0089 | 31 | 51 | 0.52 | 0.0063 | 0.618 | 0.000113 |
| CTGGTGCTGGGTGCCCTACCAAG | 35 | 38 | 0.91 | 0.176 | 37 | 36 | 1.03 | 1.000 | 36 | 34 | 0.93 | 0.808 | 0.955 | 0.792 |
| CCGATAATGGTTGCTATCTAACG | 23 | 32 | 0.70 | 0.220 | 25 | 26 | 0.96 | 0.888 | 37 | 26 | 1.27 | 0.372 | 0.961 | 0.860 |
| CCGATAACGGTTAGCCTCCCAAG | 21 | 23 | 0.90 | 0.762 | 34 | 30 | 1.14 | 0.703 | 20 | 17 | 1.04 | 1.000 | 1.035 | 0.906 |
| Other | 151 | 135 | 1.13 | 0.368 | 174 | 148 | 1.21 | 0.128 | 128 | 145 | 0.75 | 0.030 | 1.017 | 0.849 |

[a]Haplotypes built on: rs7530511, rs10489629, rs4655692, rs2201841, rs11465804, rs10489628, rs1343152, rs10789229, rs10889671, rs11209026, rs10889674, rs12085634, rs1343151, rs1008193, rs6693831, rs10889675, rs11465827, rs10889677, rs4655531, rs11209030, rs1857292, rs11209031, and rs11209032, respectively.
[b]Pseudo-Gibbs sampling algorithm in SNPAnalyzer used
[c]Fisher's Exact test
[d]Mantel-Haenszel common odds ratio
[e]Continuity-corrected Mantel-Haenszel P-value

TABLE 8

Twelve marker reduced haplotypes

| Haplotype[a,b] | Sample Set 1 | | | | Sample Set 2 | | | | Sample Set 3 | | | |
|---|---|---|---|---|---|---|---|---|---|---|---|---|
| | Cases | Controls | OR | P-value[c] | Cases | Controls | OR | P-value[c] | Cases | Controls | OR | P-value[c] |
| GGGTCCTACCAA | 256 | 217 | 1.374 | 0.055 | 270 | 255 | 1.125 | 0.476 | 280 | 225 | 1.238 | 0.227 |
| AATTGCTCCACG | 190 | 186 | 1.092 | 0.954 | 213 | 202 | 1.105 | 0.581 | 220 | 161 | 1.372 | 0.043 |
| AGTTCCTCCCAG | 116 | 156 | 0.729 | 0.0070 | 124 | 174 | 0.668 | 0.0017 | 114 | 143 | 0.676 | 0.0029 |
| AATTCATCTCAG | 90 | 75 | 1.291 | 0.255 | 71 | 77 | 0.932 | 0.609 | 76 | 72 | 0.963 | 0.668 |
| AGGACCTCCCAG | 85 | 66 | 1.394 | 0.127 | 78 | 74 | 1.082 | 0.800 | 77 | 48 | 1.530 | 0.077 |
| GGGTCCTACCAG | 36 | 39 | 0.961 | 0.724 | 38 | 38 | 1.019 | 1.000 | 38 | 35 | 0.994 | 0.905 |
| AATTGCTCCCAG | 34 | 42 | 0.836 | 0.350 | 56 | 57 | 1.000 | 0.923 | 32 | 38 | 0.760 | 0.223 |
| AATTCATCTACG | 24 | 34 | 0.727 | 0.183 | 28 | 26 | 1.100 | 0.890 | 37 | 27 | 1.270 | 0.524 |
| Other | 93 | 99 | 0.977 | 0.595 | 108 | 81 | 1.421 | 0.047 | 86 | 99 | 0.766 | 0.062 |

TABLE 8-continued

| | Twelve marker reduced haplotypes | | | |
|---|---|---|---|---|
| | Frequency | | | |
| Haplotype | Case | Control | OR[d] | P[e] |
| AGTTCCTCCCAG | 0.123 | 0.172 | 0.677 | 3.19E-07 |
| All Other | 0.877 | 0.828 | | |

[a]Haplotypes built on: rs2201841, rs10489628, 10889674, rs12085634, rs1008193, rs10889675, rs11465827, rs10889677, rs4655531, rs11209030, rs11209031, and rs11209032, respectively.
[b]Haplotype estimates were from the pseudo-Gibbs algorithm in the SNPAnalyzer program.
[c]Fisher's Exact test
[d]Mantel-Haenszel Common OR
[e]Continuity-Corrected Mantel-Haenszel P-value

TABLE 9

| SNP set | Indiv 9-SNP haplotype | | control_ freq (counts) | case_ freq (counts) | Hap.P |
|---|---|---|---|---|---|
| rs2546892 | S0048 | GAGCCATTG | 0.170 (156) | 0.119 (111) | 0.001739 |
| rs1433048 | S0056A | GAGCCATTG | 0.189 (188) | 0.097 (96) | 8.51E-09 |
| rs6894567 | A0019 | GAGCCATTG | 0.164 (138) | 0.121 (116) | 0.011771 |
| rs17860508 | | | | | |
| rs7709212 | | | | Comb P | 2.2E-11 |
| rs953861 | | | | | |
| rs6869411 | | | | | |
| rs1833754 | | | | | |
| rs6861600 | | | | | |

TABLE 10

| SNP set | S0048 | control freq (counts) | case freq (counts) | Hap.P | Global |
|---|---|---|---|---|---|
| rs1368437 | GGTGTTTTC | 0.022 (20) | 0.028 (26) | 0.460695 | 0.003899 |
| rs2082412 | CGTATTCGC | 0.176 (161) | 0.187 (174) | 0.510331 | 0.003899 |
| rs7730390 | CGTGGTCGT | 0.190 (174) | 0.205 (191) | 0.450394 | 0.003899 |
| rs3181225 | GGTGTTCGC | 0.069 (63) | 0.090 (84) | 0.097427 | 0.003899 |
| rs1368439 | CACGTGCGC | 0.207 (190) | 0.144 (134) | 0.000429 | 0.003899 |
| rs3212227 | CGTGTTCGC | 0.324 (297) | 0.343 (320) | 0.383258 | 0.003899 |
| rs3213120 | Other | 0.013 (11) | 0.004 (3) | | |
| rs3213119 | | | | | |

| | S0056A | control_ freq (counts) | case_ freq (counts) | Hap.P | Global |
|---|---|---|---|---|---|
| rs2853696 | | | | | |
| | CGTATTCGC | 0.176 (175) | 0.173 (172) | 8.12E-01 | 5.28E-05 |
| | GGTGTTCGC | 0.067 (66) | 0.101 (100) | 4.01E-03 | 5.28E-05 |
| | CGTGGTCGT | 0.181 (180) | 0.226 (225) | 1.42E-02 | 5.28E-05 |
| | CACGTGCGC | 0.223 (221) | 0.140 (139) | 3.48E-06 | 5.28E-05 |

TABLE 10-continued

| | | | | |
|---|---|---|---|---|
| CGTGTTCGC | 0.308 (306) | 0.325 (324) | 4.58E-01 | 5.28E-05 |
| GGTGTTTTC | 0.032 (31) | 0.026 (25) | 3.99E-01 | 5.28E-05 |
| Other | 0.013 (13) | 0.009 (8) | | |

| A0019 | control_freq (counts) | case_freq (counts) | Hap.P | Global |
|---|---|---|---|---|
| GGTGTTTTC | 0.030 (25) | 0.021 (20) | 0.222102 | 0.023735 |
| CGTATTCGC | 0.171 (145) | 0.165 (158) | 0.714954 | 0.023735 |
| GGTGTTCGC | 0.074 (62) | 0.083 (79) | 0.48817 | 0.023735 |
| CGTGGTCGT | 0.175 (147) | 0.217 (208) | 0.02158 | 0.023735 |
| CACGTGCGC | 0.212 (179) | 0.162 (155) | 0.007201 | 0.023735 |
| CGTGTTCGC | 0.331 (280) | 0.337 (324) | 0.793763 | 0.023735 |
| Other | 0.007 (6) | 0.015 (14) | | |
| CACGTGCGC | | | Comb P | 1.03E-09 |
| | | Global | Comb P | 2.84E-07 |

TABLE 11

| Marker | Gene | Genotyped or Imputed | P-value | Odds Ratio | OR95l | OR95u | Major allele | Minor allele | frequency of minor allele in cases | frequency of minor allele in controls |
|---|---|---|---|---|---|---|---|---|---|---|
| rs6859018 | | Imputation | 1.31E-10 | 0.636 | 0.555 | 0.731 | G | A | 0.150 | 0.216 |
| rs10072923 | | Imputation | 1.41E-10 | 0.637 | 0.555 | 0.731 | T | C | 0.150 | 0.217 |
| rs2421047 | IL12B | Imputation | 2.05E-10 | 0.640 | 0.558 | 0.734 | G | A | 0.150 | 0.216 |
| rs4921442 | UBLCP1 | Imputation | 2.52E-10 | 0.641 | 0.558 | 0.735 | C | G | 0.151 | 0.217 |
| rs10056599 | | Imputation | 2.55E-10 | 0.642 | 0.559 | 0.736 | T | G | 0.152 | 0.217 |
| rs3213097 | IL12B | Imputation | 2.60E-10 | 0.641 | 0.559 | 0.736 | A | T | 0.150 | 0.216 |
| rs3212218 | IL12B | Imputation | 2.78E-10 | 0.642 | 0.559 | 0.737 | C | A | 0.151 | 0.216 |
| rs3212219 | IL12B | Imputation | 3.02E-10 | 0.642 | 0.559 | 0.737 | C | A | 0.151 | 0.216 |
| rs3212227 | IL12B | Genotyping | 3.44E-10 | 0.643 | 0.560 | 0.738 | T | G | 0.150 | 0.215 |
| rs7730390 | | Genotyping | 4.08E-10 | 0.644 | 0.561 | 0.739 | T | C | 0.151 | 0.216 |
| rs3213093 | IL12B | Genotyping | 4.30E-10 | 0.645 | 0.562 | 0.740 | C | T | 0.151 | 0.215 |
| rs3213094 | IL12B | Imputation | 5.77E-10 | 0.649 | 0.566 | 0.744 | C | T | 0.155 | 0.219 |
| rs3212220 | IL12B | Genotyping | 9.02E-10 | 0.650 | 0.566 | 0.746 | G | T | 0.152 | 0.215 |
| rs2082412 | | Genotyping | 1.26E-09 | 0.652 | 0.568 | 0.748 | G | A | 0.152 | 0.214 |
| rs3212217 | IL12B | Genotyping | 1.26E-09 | 0.652 | 0.568 | 0.749 | C | G | 0.152 | 0.215 |
| rs6861600 | | Genotyping | 3.26E-09 | 0.701 | 0.623 | 0.788 | C | G | 0.248 | 0.320 |
| rs12522665 | | Imputation | 4.14E-09 | 0.703 | 0.624 | 0.790 | C | T | 0.249 | 0.320 |
| rs6887695 | | Genotyping | 5.26E-09 | 0.704 | 0.626 | 0.792 | G | C | 0.249 | 0.320 |
| rs6556412 | | Imputation | 6.25E-09 | 0.702 | 0.623 | 0.791 | G | A | 0.253 | 0.325 |
| rs6864071 | | Imputation | 6.25E-09 | 0.702 | 0.623 | 0.791 | G | A | 0.253 | 0.325 |
| rs4379175 | | Imputation | 6.25E-09 | 0.702 | 0.623 | 0.791 | G | T | 0.253 | 0.325 |
| rs6894567 | IL12B | Genotyping | 7.52E-09 | 0.665 | 0.579 | 0.764 | A | G | 0.150 | 0.210 |
| rs7704367 | | Genotyping | 8.26E-09 | 0.707 | 0.629 | 0.796 | A | C | 0.250 | 0.320 |
| rs7725339 | | Imputation | 9.21E-09 | 0.704 | 0.625 | 0.794 | G | T | 0.253 | 0.324 |
| rs11135059 | | Imputation | 1.17E-08 | 0.706 | 0.626 | 0.796 | G | A | 0.254 | 0.324 |
| rs7709212 | | Genotyping | 5.42E-08 | 0.727 | 0.648 | 0.815 | T | C | 0.272 | 0.339 |
| rs6556411 | | Imputation | 2.59E-06 | 1.318 | 1.175 | 1.479 | T | G | 0.366 | 0.306 |
| rs4244437 | | Imputation | 3.41E-06 | 1.314 | 1.171 | 1.474 | A | G | 0.366 | 0.307 |
| rs983825 | | Imputation | 3.41E-06 | 1.314 | 1.171 | 1.474 | A | C | 0.366 | 0.307 |
| rs6556416 | | Imputation | 9.68E-06 | 1.306 | 1.160 | 1.471 | C | A | 0.354 | 0.297 |
| rs6556405 | RNF145 | Imputation | 4.20E-05 | 0.778 | 0.690 | 0.877 | T | C | 0.233 | 0.280 |
| rs918520 | | Genotyping | 7.28E-05 | 1.289 | 1.137 | 1.462 | C | G | 0.252 | 0.207 |
| rs7715173 | | Imputation | 8.49E-05 | 0.770 | 0.675 | 0.877 | T | C | 0.183 | 0.225 |
| rs6870828 | | Imputation | 9.25E-05 | 1.234 | 1.110 | 1.371 | T | C | 0.514 | 0.462 |
| rs7719425 | | Genotyping | 0.000106687 | 0.773 | 0.678 | 0.880 | T | C | 0.184 | 0.225 |
| rs1422877 | | Imputation | 0.000112734 | 0.798 | 0.711 | 0.895 | A | G | 0.326 | 0.378 |
| rs1549922 | | Imputation | 0.000132703 | 0.814 | 0.732 | 0.904 | G | A | 0.448 | 0.500 |
| rs1473247 | RNF145 | Imputation | 0.000145486 | 0.793 | 0.704 | 0.894 | T | C | 0.237 | 0.282 |
| rs4921483 | | Imputation | 0.000145879 | 1.314 | 1.141 | 1.513 | G | A | 0.200 | 0.161 |
| rs1897565 | RNF145 | Genotyping | 0.000150046 | 0.794 | 0.704 | 0.894 | T | C | 0.235 | 0.279 |
| rs6888950 | RNF145 | Genotyping | 0.000151216 | 0.793 | 0.703 | 0.894 | T | G | 0.235 | 0.279 |
| rs12651787 | | Imputation | 0.000169251 | 0.803 | 0.717 | 0.900 | T | C | 0.326 | 0.376 |

TABLE 11-continued

| Marker | Gene | Genotyped or Imputed | P-value | Odds Ratio | OR95l | OR95u | Major allele | Minor allele | frequency of minor allele in cases | frequency of minor allele in controls |
|---|---|---|---|---|---|---|---|---|---|---|
| rs4921493 | | Imputation | 0.000251817 | 0.809 | 0.722 | 0.906 | T | C | 0.324 | 0.373 |
| rs10076782 | RNF145 | Genotyping | 0.000288586 | 0.801 | 0.711 | 0.903 | G | A | 0.238 | 0.280 |
| rs1363670 | | Imputation | 0.000361505 | 1.285 | 1.120 | 1.475 | G | C | 0.204 | 0.168 |
| rs1984811 | | Imputation | 0.000371323 | 1.250 | 1.105 | 1.413 | A | G | 0.276 | 0.234 |
| rs1422878 | | Genotyping | 0.000371662 | 0.818 | 0.733 | 0.914 | C | T | 0.317 | 0.362 |
| rs953861 | | Genotyping | 0.000388002 | 1.283 | 1.118 | 1.473 | A | G | 0.205 | 0.169 |
| rs1157509 | | Imputation | 0.000459256 | 1.280 | 1.115 | 1.469 | G | A | 0.203 | 0.168 |
| rs1157510 | | Imputation | 0.000459256 | 1.280 | 1.115 | 1.469 | C | T | 0.203 | 0.168 |
| rs11749573 | | Imputation | 0.000459256 | 1.280 | 1.115 | 1.469 | A | G | 0.203 | 0.168 |
| rs9313808 | | Imputation | 0.000459256 | 1.280 | 1.115 | 1.469 | G | A | 0.203 | 0.168 |
| rs2853694 | IL12B | Genotyping | 0.000544359 | 0.830 | 0.747 | 0.923 | G | T | 0.449 | 0.495 |
| rs4921499 | | Imputation | 0.000588348 | 1.232 | 1.094 | 1.388 | G | A | 0.286 | 0.246 |
| rs4921500 | | Imputation | 0.000588348 | 1.232 | 1.094 | 1.388 | G | A | 0.286 | 0.246 |
| rs7702534 | | Imputation | 0.000588348 | 1.232 | 1.094 | 1.388 | G | T | 0.286 | 0.246 |
| rs254843 | | Imputation | 0.000687505 | 1.258 | 1.102 | 1.437 | C | T | 0.227 | 0.190 |
| rs4921504 | | Imputation | 0.000705248 | 0.784 | 0.681 | 0.902 | C | G | 0.181 | 0.217 |
| rs2421186 | | Imputation | 0.000705248 | 0.784 | 0.681 | 0.902 | A | C | 0.181 | 0.217 |
| rs254852 | | Imputation | 0.000817419 | 1.254 | 1.098 | 1.432 | A | T | 0.223 | 0.188 |
| rs254850 | | Imputation | 0.000817419 | 1.254 | 1.098 | 1.432 | C | T | 0.223 | 0.188 |
| rs254839 | | Imputation | 0.000836466 | 1.256 | 1.099 | 1.436 | T | A | 0.225 | 0.189 |
| rs4921200 | | Imputation | 0.000836466 | 1.256 | 1.099 | 1.436 | A | T | 0.225 | 0.189 |
| rs4921496 | | Genotyping | 0.000990418 | 1.220 | 1.084 | 1.373 | C | T | 0.287 | 0.249 |
| rs10042630 | UBLCP1 | Imputation | 0.001080853 | 1.249 | 1.093 | 1.427 | T | A | 0.218 | 0.184 |
| rs4921458 | | Imputation | 0.001132692 | 1.248 | 1.092 | 1.426 | C | T | 0.218 | 0.184 |
| rs4921437 | UBLCP1 | Imputation | 0.001252363 | 1.245 | 1.090 | 1.423 | C | T | 0.218 | 0.184 |
| rs10515780 | UBLCP1 | Imputation | 0.001252363 | 1.245 | 1.090 | 1.423 | G | C | 0.218 | 0.184 |
| rs10866711 | UBLCP1 | Imputation | 0.001252363 | 1.245 | 1.090 | 1.423 | C | T | 0.218 | 0.184 |
| rs7708700 | UBLCP1 | Imputation | 0.001252363 | 1.245 | 1.090 | 1.423 | C | T | 0.218 | 0.184 |
| rs10515782 | UBLCP1 | Imputation | 0.001252363 | 1.245 | 1.090 | 1.423 | T | C | 0.218 | 0.184 |
| rs7736656 | UBLCP1 | Imputation | 0.001252363 | 1.245 | 1.090 | 1.423 | G | A | 0.218 | 0.184 |
| rs4921230 | | Genotyping | 0.001269997 | 0.813 | 0.717 | 0.922 | C | T | 0.209 | 0.245 |
| rs12657996 | | Imputation | 0.001330019 | 0.790 | 0.684 | 0.912 | G | A | 0.172 | 0.207 |
| rs1368439 | IL12B | Genotyping | 0.001332138 | 1.243 | 1.089 | 1.420 | T | G | 0.217 | 0.183 |
| rs1865014 | | Imputation | 0.001433642 | 1.241 | 1.087 | 1.418 | C | T | 0.216 | 0.182 |
| rs6874870 | | Imputation | 0.001792749 | 1.236 | 1.082 | 1.412 | C | T | 0.216 | 0.183 |
| rs2853696 | IL12B | Genotyping | 0.001902523 | 1.234 | 1.081 | 1.410 | C | T | 0.217 | 0.184 |
| rs1433047 | | Imputation | 0.002006695 | 1.233 | 1.080 | 1.409 | C | T | 0.216 | 0.183 |
| rs1433048 | IL12B | Genotyping | 0.00236978 | 1.230 | 1.076 | 1.406 | A | G | 0.218 | 0.185 |
| rs270659 | | Imputation | 0.00276249 | 1.238 | 1.076 | 1.423 | T | C | 0.192 | 0.162 |
| rs13178603 | RNF145 | Imputation | 0.004508011 | 1.212 | 1.061 | 1.384 | G | C | 0.217 | 0.187 |
| rs270661 | | Genotyping | 0.004825491 | 1.207 | 1.059 | 1.376 | C | T | 0.215 | 0.185 |
| rs13158488 | RNF145 | Imputation | 0.004904697 | 1.209 | 1.059 | 1.380 | T | C | 0.216 | 0.186 |
| rs17663721 | RNF145 | Imputation | 0.005027418 | 1.208 | 1.059 | 1.379 | T | C | 0.216 | 0.186 |
| rs11574790 | IL12B | Imputation | 0.005211623 | 1.318 | 1.086 | 1.600 | G | A | 0.092 | 0.071 |
| rs2195940 | IL12B | Imputation | 0.006176876 | 1.311 | 1.080 | 1.591 | C | T | 0.092 | 0.072 |
| rs2116821 | | Imputation | 0.011425124 | 0.871 | 0.782 | 0.969 | C | T | 0.367 | 0.399 |
| rs7732511 | | Imputation | 0.012287922 | 1.216 | 1.043 | 1.417 | G | A | 0.160 | 0.136 |
| rs1433046 | UBLCP1 | Imputation | 0.015431773 | 0.876 | 0.786 | 0.975 | T | C | 0.370 | 0.402 |
| rs194228 | | Imputation | 0.015866292 | 0.876 | 0.787 | 0.975 | G | A | 0.369 | 0.401 |
| rs2420825 | UBLCP1 | Imputation | 0.015866292 | 0.876 | 0.787 | 0.975 | T | C | 0.369 | 0.401 |
| rs3734104 | UBLCP1 | Imputation | 0.015866292 | 0.876 | 0.787 | 0.975 | G | C | 0.369 | 0.401 |
| rs17665189 | UBLCP1 | Imputation | 0.015866292 | 0.876 | 0.787 | 0.975 | T | G | 0.369 | 0.401 |
| rs17860508 | | Genotyping | 0.01770095 | 0.882 | 0.794 | 0.978 | T | C | 0.465 | 0.497 |
| rs254837 | | Imputation | 0.018638426 | 1.234 | 1.036 | 1.470 | C | G | 0.113 | 0.094 |
| rs11746138 | | Imputation | 0.025056654 | 1.190 | 1.022 | 1.385 | C | T | 0.157 | 0.136 |
| rs11747112 | | Imputation | 0.025056654 | 1.190 | 1.022 | 1.385 | C | G | 0.157 | 0.136 |
| rs12652431 | | Imputation | 0.027069579 | 1.213 | 1.022 | 1.440 | A | G | 0.122 | 0.104 |
| rs1368437 | UBLCP1 | Genotyping | 0.02847955 | 1.211 | 1.020 | 1.437 | C | G | 0.118 | 0.100 |
| rs12520035 | UBLCP1 | Imputation | 0.033981552 | 1.202 | 1.014 | 1.425 | A | G | 0.118 | 0.101 |
| rs270654 | | Genotyping | 0.036760864 | 1.198 | 1.011 | 1.420 | T | C | 0.119 | 0.102 |
| rs919766 | IL12B | Genotyping | 0.040074923 | 1.193 | 1.008 | 1.412 | A | C | 0.122 | 0.105 |
| rs4921466 | | Imputation | 0.041237398 | 1.195 | 1.007 | 1.418 | T | C | 0.117 | 0.100 |
| rs3181224 | | Imputation | 0.048412617 | 1.184 | 1.001 | 1.401 | A | G | 0.122 | 0.106 |

SEQUENCE LISTING (541 sequences)

SEQ ID NO: 1 - DNA, 2347 bp, Homo sapiens
ctgtttcagggccattggactctccgtcctgcccagagcaagatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccctgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatc

SEQ ID NO: 2 - DNA, 2826 bp, Homo sapiens
acaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatgttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctggaaaaaaaaaaaaaa

SEQ ID NO: 3 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 4 - protein, 629 aa, Homo sapiens
MNQVTIQWDAVIALYILFSWCHGGITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 5 - DNA, 201 bp, Homo sapiens
aagacacaacggaatagacccaaaaagataatttctatctgatttgctttaaaacgtttttttaggatcacaatgatatctttgctgtatttgtatagttmgatgctaaatgctcattgaaacaatcagctaatttatgtatagattttccagctctcaagttgccatgggccttcatgctatttaaatatttaagtaatt

SEQ ID NO: 6 - DNA, 201 bp, Homo sapiens
cacggtcatctgccgcaaaaatgccagcattagcgtgcgggcccaggaccgctactatagctcatcttggagcgaatgggcatctgtgccctgcagttagrttctgatccaggatgaaaatttggaggaaaagtggaagatattaagcaaaatgtttaaagacacaacggaatagacccaaaaagataatttctatctgat

SEQ ID NO: 7 - DNA, 201 bp, Homo sapiens
tgtctggaaggcaaaaagatcttaagattcaagagagaggacaagtagttatggctaaggacatgaaattgtcagaatggcaggtggcttcttaacagccmtgtgagaagcagacagatgcaaagaaaatctggaatccctttctcattagcatgaatgaacctgatacacaattatgaccagaaaatatggctccatgaa

SEQ ID NO: 8 - DNA, 201 bp, Homo sapiens
ccacattcctacttctccctgacattctgcgttcaggtccagggcaagagcaagagagaaaagaaagatagagtcttcacggacaagacctcagccacggkcatctgccgcaaaaatgccagcattagcgtgcgggcccaggaccgctactatagctcatcttggagcgaatgggcatctgtgccctgcagttaggttctg

SEQ ID NO: 9 - DNA, 201 bp, Homo sapiens
ctgacaacagaggagacattggacttttattgggaatgatcgtctttgctgttatgttgtcaattctttctttgattgggatatttaacagatcattccgractgggattaaaagaaggatcttattgttaataccaaagtggctttatgaagatattcctaatatgaaaaacagcaatgttgtgaaaatgctacaggaaa

SEQ ID NO: 10 - DNA, 201 bp, Homo sapiens
tgcaacagtcagaattctacttggagccaaacattaagtacgtatttcaagtgagatgtcaagaaacaggcaaaaggtactggcagccttggagttcactyttttttcataaaacacctgaaacagttccccaggtcacatcaaaagcattccaacatgacacatggaattctgggctaacagttgcttccatctctacag

SEQ ID NO: 11 - DNA, 201 bp, Homo sapiens
atcttgtttccagagtagtgacatttctgtgctcctaccatcaccatgtaagaattcccgggagctccatgcctttttaattttagccattcttctgcctmatttcttaaaattagagaattaaggtcccgaaggtggaacatgcttcatggtcacacatacaggcacaaaaacagcattatgtggacgcctcatgtattt

SEQ ID NO: 12 - DNA, 201 bp, Homo sapiens
gaggagttgccatctattaatacttattttccacaaaatattttggaaagccacttcaataggatttcactcttggaaaagtagagctgtgtggtcaaaakcaatatgagaaagctgccttgcaatctgaacttgggttttccctgcaatagaaattgaattctgcctctttttgaaaaaaatgtattcacatacaaatct

SEQ ID NO: 13 - DNA, 69926 bp, Homo sapiens
tttctcgcagagtgaaagagtacaaagtggaaattttgaatcctcccagggaagggaaaaagcttttggtgctagatgttgattatacattatttggtaagtcagttaagaatgcttttcattttctgttacccacaacaactctttttttcttttctttgttttttttttttcttagcaactcatggttctcgtgaaatacttgaaaacttttcttattacaaaagtaaattgctcattgtaaaaaatacagataagcaaaaaaaaaagtcatctgtaatcctgatacccaaagatgaccactcttagtaatttgatatatatcttttagactgtttgtatggatctcctctaaatcttttatttaataacacattgaacatcttctcagtaaaatattgtttattatgaatgatatatatatatgtgtgtgtgtgtatatatatttttttatttttttggccagaaagtattctagtttatggatgcatcatcatttaaccatgttattccctgttgattataaataattttttataaggaatattttaaaaattatgtttgatattttatcactagttttctgtttagttatattcaagcagattcttgaatttaaaatttctcatgtaggccaggtgcagtggctcacatatgtatcctggcactttggaaggctgaggtgggaggattgcttgagctcaggagttggaaatcaacctgggcaacagagcaagacctcatctctaataaaaactaaaaatactcgctggatgtggtggtatgcacctagtcccagctactttaggaggctgaggtgggaggatcacttgagcccggattaagactgcagtgagctatggagtgccactgcactccaacctgggtgacagagtaagaccctgtctcaaaaaaaaagaaagaaaaaaatgttttgtgttcattgaaaaagaaagatgttccttttatgtctaatgttggcaagaaatagttaacttctgatactggaatttatttctaaccctaaacctaaaacataagttaatgtacagtttttaaaaatttaattaattggttaattggcctgtcattttgatgaaatgtgattatatctgcaaggtagatgactaaaggtgagtataagtggacatagtttgtttttcattattaaaaaataacatctaaactttagagactaggtgagaaaaaaattttcagtttactacttaagcctgaattttcagtattgctttttgcaaattgaacaaaattgatcgactaaaattggatcttaaggattttaaattgtgttttgaaagacatctttttgtcagccaacgtaattcagtctgaagcagtttgcaatgaaatgtttatgtttgcatttcgtaatatattacatttaataataattggtattaggtacttgttcatgatggtaaactaataattatttatgatcaattttcttttagaccacaggtcttgtgcagagactggggtagaattaatgcggccatatcttcatgaatttctaacatctgcctatgaagattatgacattgttatttggtgtaagctgtatttttttgtttagatttccgtggaaataggttgttccatatattattgtgctgtataaaatgtgacttaaaatgacctgtgtttaaatatgaaatagttttcattttttagcaaatttctaaaatgaagcatgtatcacaatataaacttaaacatatattggccaaataccagtgagatagttaatttaactataggacatgagtacattatagtgtaagaataaaaatgactaattttcccaatgaccccaccttgatttgaagtttttccttctgattttttttttttttaactaggcacatatctttagggtctcgctgtgttgcccagactggttttgaactcctgggctcaagtgatcctcctgccttggcctcccaaagtgctggattacaggcataagccaatgtgcccagcctttccttctgatctttgctgtgaaattcttgatgcttcagaatatttttcttttctccttttttcctgactccagttttaaaatacttggaaaaaggtgtttaaaacaaaatcacagtgatatagttctctggaaataaaggcaacttgaattacttaaggaaaaattaatatgtggactaaagccagtgacattgaaattgtggtctgcggaccatttcaagaatgtacaggtctgtgataagatactgagtttgttccaagaagtaaatatactgtaatcgtaagcacactattcagttcaattaacgttttttggtagcaagattttcttggaaaatgaagcaatgcattgatttacatccctcctccccacaaatatttaaagttgcctcttggcaatgtcataagcagagaagagttatcctgactgaattaaatgaagtcccatcaagtaaaggtgctacatttcattgtactaggtctttgagagaaattatgttagttgttgcagtctgtaaattcattttgtatttttccttataatcagagtacttccgttgtttgtgatatgtgagttccatgtgagttcacagctgttaagattaaaattattgtcaaaatatataattttctggtttagtaagataaggtgaagaaagcttgctggtttgtttagcaactttgacatctaagatgatatttgagaaaaaagtttatcctttaaatgttattaaactagacttataaaatttgagaaccttttacaatagtatatttaaattatttttataaactgtgatattttgtggtagttcattgaaaagagtacttcactttggagctaaatagactaggattttaattctggctctgttcttactgtgtgacactggacaggtcacttaatctttctgagccttagttccctcacttgagaaatgaagatatctaaatacatattacaggttagttgtaagaatagaagtatcaatatagcaactagtactatgtctgacatatagttacttaataattagaaactttttattagctgtgggtctttttgtttttcgtctgataattacagatacaaagtaagtaccggattaaaatttttttctatcttatgattattttcattggagatacaatagtctttaaaattttagctcaactgaccagttttgtacgtgtaaggtgattcttctgtttttttgtatgtgtgcatgctgaagattttttattttgagaactcaggttcctcttttgcttttaaaaatcacacacacacacacacacacacacacacacacacttcaaataattaaattgctttttctctttttaaacattttacttggttatacctgtatagtttagtccagtaaaccaggagagcacataaagatgaggatttaattttagtattaatgatctcaaagctggttaatgtctgacaatgagcagatacatgatgcaggtatacttcatgaatttgtctcatttcttgttagaagctgctagactcagtgagctttaatttgctgagactgacaaaatgcagattttcactgaacctgactagctggttttcaacataaacttttgacacataacaatatgcttatattgacactatgtatacctgtgcattgcctagaagtaggaacatggaaaaaagtgatccaggcacccaagtttaagtttggaattgatagagtgtcagggctgatttaaaaagagagtttaggtcttgatttataaatttcctaggttcagagttcttttgagcatggattacctgtatcttacagataaaagttgtttaaaatttattctgtcttgaagacacactgcagtaagtttacttttatcaatatttaaaagaaaattaccataagtatgctagggactgttaattctgatgcatttaaacttttagttttgcttagaaaacttacttatacagattttttttaaagaaattcaagcttttcatatgtattgtattatcattcctcgtgttttagctgcaacaaatatgaagtggattgaagctaaaatgaaagtaagtgttagaaagcaatccatttaaaaatattttcaaactgcatttgtcttgttaaaagttctagaactgaattaattttattcttactggagggcacttagtagatagataaatgccattattgggagtagaggtgtttttaaagtgtgtttaataagtggattgtactgaatccctaagtcttttttaagaaaaagtataactaagcttgtcccctcccccacattcttcctcattttacaataatactttattttccttcttttgctctagtgtgcaatacttaaagagtcagtattctcctaaaatggtaaattaggaagtaatctatttctattttccttggtttaccatttattgacttggctaagtgaaactaaaatacttcctagttgtttagcaagatgtagtggccagtggtgtagaaagttggcattatgagaaattgcagctagaatattcagaaaatctgaaattttccacactactatgttttaacctcacaaatatttgtgtttataggagctgggagtgagcacaaatgcaaattataagattactttcatgttggatagtgctgctatgataacagtacatactccaaggagaggattaatagacgtaagaagtcattttatttctatttaatgacaccatggttattttccagtgtactttttatgtttatacctatggagtaaatagtgtagagattcatctgagtgaataataaagtggttgagttttgacataggaaaatgtatttaaggttaaaagatttttttttttttttttttttttttttgagatggagtctcattgtgccgcccaggctggagtgcagtggtgcaatctcgctcacgcaagctccgcctcccaggttcacgccattctcctgcctcagcctcctgagtagctgggactacaggcacccgccaccacgcccggctaattttttcgtattttcagtagagacggagtttcactgttgttagccaggatggtctcgatctcctgacctcgtgatccgcctgcctcggcctcccaaagtgctgggattatgggcgtgagccactgtgcccagccaaggttaaaagatttgaattttaatgataaaattagggatcttgaagtaggactgtcaagaaaggaacttgtgattgtgggtaattgacctgtgttgatgacagcacaatgttactgggcagagtaggtgagaaaaatactgaatattatcaaggaagatactagaaacaagcgaaaacactcaccctgccctgtttgaaactggtaataaaagcagatgcatcatgatgcatgtactttgggatgatgctgaagaatagcaacaagaacaatcagagaaaagggtttggctaaccagttattttactcatcaagtaactactcatactattaagtatctactgtctggaaggccctgtgataggcactgttgggaataaagagatgagtgagacacagtccatatcatttgaaagcacccaaactgttagctgggctggataatgcatgcctgtaatcccagctactcaggaggctgaggcaggagaattgctcaaacccagggggcggtggttgcagtgagctaagattgagccactgcactccagcctgggtgacagagcaagattctgtctcaacaaaataaagtaaaataaaagcacccaaactaataggaattgaggagaacttaggatacgaggaaaccttaggggagacagtattaaaattatcaaaaccataaatagaatgatttaagggcatggggacttgttctataaaggaaatactgcatgtatcgagaaaaagataacttactatatactaaagtaaaataatacatttacaaaatcttaacattaaaaattacttagggaaatgttaaacatgttttataacagtgaaaaattaaaggaataaaaataatcctcaatatccagcaatagggcattggatatataaattactgctacccatataagggactgtagctcgtcatttgatgtagtaggatatgtaatgatttagaaattttcatgacacatttaagtgaaagaagtattttagagaacactgttgtaagccgttagaaaatagttcttaacctttgtttggttcaggattacccttaatttaacaaagaacctgtcaactctctgaggctgctcttgtttataaaaatgcctggagtcaatgtatcagaatattgagttgttgcccttggtactgactagattattgatttaaaattttcctttatgcttttcagtattttcatgttttttttctgtagttagcaatattacttttctaattgagagcaaagtagtttgtgttttggggaacataggtgcttgacctaattaacaaatgacagcactttttaagaggatgtaggatttttattctggatgtcataaaaaatgacctctgttgtcatatttcttgaggcttttgttagctaaaaatccacaaaatatggcttattgtattaattcttatatatttgtcttcatttcgtggggggagtagggggcggtttctatttcggtagtaaacaagatcagtagcaaaaaaaaatcaggaaagtaaaattttagtaaattaaaatatttcattaacattttttgtaataggcaagacaataggaaggaaaaagctttctccaaattaaattataggaggaaaaaaatttttaagttacaacttttatcactatttatttcttaccacttaatctcatatatttattattacattctgttctcataataccgtaagacttctgtcttcagcaaaagtaattttctagaaatttaaaaaattttctgaatgtgtaatacatttgcatgactaaaaaaatagtaaagtacataatgaaaagtcatctttcacctggtacctagccacaatcagtgttatttcctgtgtggtcttacagagactttacacaaataccaacaggtaagactatataagaaattatttatttgaagcttcagtttaagaattcagaaataagagtaagaatttgtaaaatatggtgcttccgaagttaagcaatcaaattccctagaaattatgcacctgtgccactgagttaaagacaaaacgagtttttcctctataaaatattcaaattattaattgaaaaagccaaatacagtttttttttgactagggtgttctagttttgaaagcagactccatgtgactcccaagctctgagaaggaatgtgttaaccaaggaagtcatgtgactgcatagcagacatctaaacaattactttggatttttaaaaaattaaataatttatttattttacccaaaatcttcacgttaaaattatggaaagttttataatgggtttagttcagttggacatgaacaaacctttcagaagttttaatattgcaaaatgcattgtgctttaaagtgggttgcatttaatgattagctcacacctgtcttacagggggaaaggaacactttggcattgttctgcagggcagtttgcagtattcctgcttttaagacaggatgaaatattgataaaatttgagttaaatgtaaacttttattctaaggtaaagcctcttggtgttatatggggaaagttttcggagttttacagcaagaaaaacaccattatgtttgatgacatagggagaaattttctaatgaacccacagaatggactaaaggtaagacatacttttacttgttatgtgctcatgtaatctgggctgtgtggtagaacttttgtagtaagcactgttgaatttcatatatttttggaagtactgtattcttatgtcataggcgagaaaagtttaagaataattcatatagaaattgaactttgtcttttttgcattgatgtctccatagttagctagttcatccaagtatttgtttgtttatttatttatttatttttgagacgggatctcactctgtcgcccaggctagagtgtggtggtgcgatctcggctcgctgcaatctccacctcctgggttcaagtgattctcctgcctcagcctcctgagtagctaggattacaggcacgcaccaccacacccagctaatttttgtatttttagtagagacagggtttcaccatgttgaccaggctgatctcaggctcctgtcctcgtgatctgcccacctcgacctcccacaagtgctgggattacaggcatgagccactgcgcccggcccaagtgttttatttttaattagctctgtgggagcaacatgggcttcccaacattgacttttagcatccaaagtgaaatcattagttatttttttaggtatacaaatcttggcattttaaacattctggttagcttgagaaatggcagtaagggtactttgttttttctttttaaactgaaactaaagacgtttttgaaaattcctagacggcaagtacagatcttagaattagacattgccagagctagaaggaaccacagtcatctcttgcctaccttcttaactttggaaacagtctgaggttgaagaagttcctgacttgcccaagattgtatatgtaactggctaatgacagaatttgggttagactctagtgacttggttcctaggtcagtgacaatcttagcatgcaactgcatgcagtcttatgtgacatttcatcctggtaacagtataaaattggtaagagtgaaatttgaaatttaaaagtttctggtacccatagttgattacatgttggcgcaatatgaaaatggaaaagatagctctatactatggcactattgcacatggagtctccattcgaagtggcagtcctgacactgagatgttttcattctcagtcctaaacttttctactagctgggtccttggtagttttaaaagacaagagagaaaaacttaaaagtacattttttaaacctttcttacagactgttgatttgagtttttgtttacaatgaggatattttagggaaagaatactaatctaggtagtgaattgccataagtataaaaactgttgacttggaagaaaagtggttatgttgtccttaatggtttctgtttaaggcttggagagaagtgcttttcttaatatgtactgcaccaggtaaaggtacaaaaatgtattcttgagtcttgagaagaaatgtggttgatgtaaacctaattgtttgtgaaacgaatggttattacctgttcttgcaaggaggtgatcccatgatggtcaaggaataattttggaggagacgtttaactttaaaaaaaaaaatacaatcattagtttcatgtttgtttaaaagaaactttgttttcctaaccaacatttgagctccattcatctcttgatgcagggagagatgttattgtaaatgtctagttctttatgttactttacagtagggtttttaaaagactgtactcagtagacccactgaaggaattcctaaaaatacgtatgtccccatcccctaaattctaattccagaggtagatttagacactccacaggctgtccttgtgtgtcttttattgaaaacctcttttttataaaattaatctacccaagataacacttcatgaaaacctcttttaaggttaaagattaaaggttaagattaagattaaagatctgcccacgtcggcatagaaacaggtggggttttctgacagggtcttgctctgtcacccaggctggagtgcagtggcatgatcagagctcattgcagcctcgacttcccttgctccagtgatcctcacatgtcagcctcccaagtaactgggactacaggcgcacgttaccacacctggctaatttttgtatttttggtagagacaaggtttcgccatgttgcctaggctggtctcgaggtcctgcactcaagcgatccacctatctcggcctctcaaagtgcaggattacaggcatgagccactgcgcccagcccagaaagagttctaaaatggagaaatatcctcaaatgctgtgttttgttatcatgctttcataatgcacttggtagaaatctcaaagatttcatgtagatcttaaaaataagactgctcatttttaaaatagttaacttctattaaacataagcttgtcagtcataaggtttgaagtacatggaaggtactgtgaatatgaatttagaattacactaaaagaatgtgaatcttggtcatggataaagcagtttatcggctgaaaactccatttttattgtctgtacaaggaaattatgatataggagaattcagcttatctagacagtcttaagtttctaaaaatgcttccttgacctgagacaagatgatggtttcctgtccttttagtgatcacttagatcagtttttaaaaatgtacagtaaacagtggttatactggagcaagtgaagtcaattaggtgcatagattttcacccttaatttgtttatttaaaattttagaaccagaatcattagaatattttagttttgttgtttaatagtgcttaagagcaaatgtttggaaagtaaaaataacttagcagagccttgggttgaaaatcttatttactacccaccaaccctgtaatttcctgctgtttaaatttggacactttggtacattatatattaattgcttaaaagttaatttgttacctttcagtccttaggaagtgaatgaaggaatactttaaaacattaccatatcacccaggattatgcagaaactcatttcactacatcctcatatcatgactctgtttactcccatccccagggcctaagcaaggccctgtaaagcgtcgtcttcagcccccacattcactgctgctcggaaacagcactgctgcactacctttttggaagtgggatctcccacaaatgctgatttctgaggagactccctttgacagctcttgactggtgcccttcaagcagtatgggagccagctaacagtgtggaggtcactggcaccaagctgttctgatgagagtagaacacctgggaaaattttcttctgtccatttcagatgggtggtgtttttccaatgacagaagaaaagtatgtaaaaaatacttaaacccttccctacacttaataggtatggtagtagactcctttgggctcactcattgttcttgcttctcagtaagtgacaatgattaaatatcattcatttttcagtgttaactgtgtaaaattaataactaatgaccaaaaaaaaaaaaaactaatgaccaatttgcattttctccaaatcaaaagaatatactaatactttgctaagtatgatgaaatcagtccttacatgtgtgctttaggaatatgtgtgctttaggaatatgtatgatttttttttaacgataacagaaaaattcaaatgtaaacagaactatataaaattgcttaaacccccatgtagatatcattcagtttaaattagcttattaattcatggatggttattgtttgctctatacgctacttccctctccttaatattttgaagtaaatcttagtcatatcatattatctaaaattaatttaaaattattgaaagactatcttgagttgtataaagatatttgagcaggtgtcttttacaaaacagcagaattctttactgaagctataaaataaggaaaagtgcataaatttatagttcaacaaactgtaaagataattcttgtaaaaaattttattccactaaaattactcatgattttcctttccaaagataaacactattaccatcttgatttatagtcctctagtctttttaagcatagatttatgcacaaatctagatgaagattgcatataaacatatgcattcatagcaccgccactcaagtcaagatatggtattccttactaattgcagtcccctacctcggtctattattctgacatgtgtggtttgaaataatgctttttaaactctttttcatcataaaatagatcagccttaaacatttggaaaatatggcagttctttttatggaaaactcttgcataattaaaaatgattttaacagagaatttaatgataaagaaaaatgcttatgataaaatgtaggaggaaacaggttatataaatgtataatgatatctcagctatataaaaatttaatagaaaaataaaataaaaatcatcgttaaaatttatctcactgtactgttagatcaagctggtattggggttaaatttttatgaataaaataatgtgaatgaaattaattagaagcaactagaatgataggaggcgggaaaggctaagtagttttgcaaagtagagtagctgtgtatggattcaagtgcaataagaaagctggtgttgtcaggttcagattgaaaagataatgttaggtaaaataggtagaagagtttgtaatttgtaaacattatacatgactttctatttaggctaatataaaagtaatttttagtatttatgttcttggtgatattttaacctcattaactctaattgaaatgatagtatagatttgttagttttccttatcacattgtgatgtgttgagtaatgtttgtttcctaatagataaggccttttatgaaagcgcacctaaatcgtgataaagacaaagaacttttaaaattaactcagtacctcaaggagatagcaaaattagatgactttttggatctaaatcacaaatattgggaaaggtaagttttaattgcttatttattttctctttacatcaatgaagaaaaaattatcatttttcatcagtgaccccagtatatatatagctgtcttaatttttatttaaaataggtgacttctaaaaacattttctaatccagtgacctacccccaaaagtattttcccctttcatcttaacctctaacttgttcataaacatacctcttgtaaactctttaatacttctagaagagagaacttgagagactagcatatgttggtgatgctgcctgtaaattattttgtgatgttaggtaagctactcctttatgaatcacatggaatataatccctcttctcatactgtaacttaatgtcaggataagataaaacacatgtaaaaatttcataaatagtattaaaaattaccagtaacttgagtgtagcagagaaattagaaaagtttatcctactaaaaaaacaattactcataattttcctttttaaagataaccactgttaccatcttggtatatagtctttcagtcttttatctaaacccaaatgtttgcacaaatctatatagacgttgcctataaacatcaaggttttgagacagagaaaagtccccagagaagtggaaggtattactatgtattacagtatttgggggggaattagatctttgaggatctggttccagtaatacagcaccaaaagaaactatttgtgtaataataacactttggcttttcagattccacttttgacttttcagatcagtttgacacaagtcttctaagagtctataatcctaataggaagataaagcagacatttttacccccatctttaaattgcaaatgatgtaactgagtcatggagatagtaaatacttagtgcagtgccacaaagtgagcaaattgtaccagcaaaacatgtccaagtttgctgattttaggaactctttccccatccccacaccaccaattatagtagtttgtaaatgttagaaatagagatcaagtttttaatttagtggtagatttctattaaacaatatgaaaaacacttgtttgcttagtaatgtcttatatcttttacactcttgatcaaagacctttagcatcttttgcccactgtcttgatgtaacaaaaataagatctttatggagtttgatctgtatttggaagttacaatactagttaatatagtgactttcacattggaagtaaggcagtatggagtggtagtcaatgagtatgacctctggagccttgttttgaatctaggctcttccactttctagctgtgtgaatttgggcaaattgcttaacctctttgtgcctgtaaaataggaataattctaatagtaactcctcagagctgttgtgaagactaaatgaattaatacatgtacttagaactgtgcgtgcacataatcagtagatgtaagtgactattaagaatactcatcttgaaatgttttgtcattagaacaaactcctttgggagcaaagttaggttatcttcatgaatttagcatgatacagctttgacatctttattttatttcttgcagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttctaaattctgagcggtctcagttaggcctgtatgtgtgtacatgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaacattcgttatctgttctatattaccacatatattttacctctttgttgaatgacaaaatgaacattatattcaggcaaggatctcttgcaaaaacttaaatgtgtatggtgatgttaaaggtgtgtatatcactatttatacattcaggagtagttttagcagctaatcagatacataaaattacttaattctaataagtaccttttttcagaaatatatactattttctttgtgacaggttttgaggatatacagtgcagaagagtttgaggactctaaagtgattcaattaaaatatatttcttaattatgaagtaaaatttaaatatttaaggatagaacagaaattttagagtattcatttttcattggtacatttttcccactgtaaaagacaacttattccaaagtacgcacggaaagggcttaatcttctcaagaaaatggaacacttaaactattaacataggtcaagaacgggcagacattttcgaaatcagtataaactaaaatacaaaagttagcaaatcacagggagcaaagtagaattttacaaaaacatattctgccattaggtggtgcccaaaccaaagcttcttagctgctgtgcttaattaagccactccggagaacattgtcattgagcttgttgagataacgtgctatatgtgattaataccattatagagtgtgggagttttcatttgtcttctgcatctcatggcttattgaacagctccatctctatatatctatgtgtgtggcacacacaattgaatcaatagatcacttaatttggatgcatattttggtgaaaccacaaattatttttatcagatacatgtgttaagcattaaaacagtattatacgaagtatatttagcctaaaaactacagaacatcagtaaatctttgattcagagggaagtttctaatttcccctcaggtctttgttaccgaaatcagttattggactaatgatacctatagcagctcttcagtgtaaaaggtaaggaatggaaaaacaggttgttacagtaagcaactgaaacttattttttattcatggaaagtaaaatagttccttgagaggaagaggaactacaggatagggactgggaaaaaaggatatgcaaaaaaacgcagattagttgcattttaggttattgcttggtttttaggtattaataacaattgggtggtcagaatggtaataaaacatgaataataaacggttgagttttctcatcccaagtactcaacagagctctctcaagggacgaactgttatggtctccaatgaagtattttacatcaaaattcaatcttcttatgaactagcccaagaaatgtctgtgaagattaaatgcttagatatttatgtaaagatttagttttgctacgtgagtcttggtgagacatctgaatattttaaatttttaattgacagttgtttatggggtacaatatagtgttttgatacatatatccaatgtggaatgattgaatcaggctaattagcatattcacctcaaatatttatcatttcctggtagtgaaaacattttaaatcctcttttttagctgttttgaagtatacgttattattaactgtagtcactatgctgtgcaatagatcaccagaatgtattcctcttattaaactgaaactttgtactctttgaccaacatctcatctttccccatccaccaccaccgccctccccaacctctggtaaccgcttttactctctgcttctgtgagtttgactttttagatttctacgtataagtgagatagtattgtgtctctctgtacctggcttatttcatttagcataatgtcctttagcttcattcatgtcacaaatgacagaatttcctgagttttttaaggctgaatagtattcatatatatatacaccatattttaaaaatccattcatcccttgataagtactttgtttttttctatatcttggctattgtaaataatgctgcagtgatcctgggattgcaggcatctcttcagagtgcttagtgtttaaatcttaagagaatctttttgtaatcagtttcatagatttagcaaagacttctgagaaattagtgccttataagaactgaaatcaatacgaagcatcctgtagggctaaaaatggtgtcagttatctagtaatgtcaatgagcttccatgtaaagtgtttaaaatcttgcacacctcccacattaataatttcgtaaaaacactttggaagtaagcaagcacttaaatgcaaacataaggatatttcctgatatgaactgttactcattaaaatgctggtttgcttccaaaaagctttaaaagctgaacttacagcttttaagaacatttgtaaacagtagaaacaaaaccttaaaaatatcaaaaacaaagactgctaagctttaatgatgtttccataaaccaatatggctatgatgaacacacattagtgtatgtgtataatttgttacactaaaggccaaactgatgacttttcaggaatctagaggtaaatcaattatttaattgaatacaaatccctcttacttttattcccagttcttaattctctggagcactgattgctattacttcttgttggataatctgtgaggagaactgctgtagcttcctaaataaggcttttgaaagagccagtggtttgtcagaaaaacatgtgactaaaatccctctttattggcaacaggaccttgggcaagtcacttcaactcatttaacttttgcttccttctacttaaaaaaattctgcacctgtctgcctttcccataggctgtggcaaagtcaaatgagacagttcccatggaaggacttggaagcagcaaaggcttatatgaatgtcagatgttaaaagtagcacagagcatgttgctatcatcgagccctatcattcctgaaatatagttaccaaaagtgaaatcttaaaaggaagacttttcttgataattttacaaatactatcttggttttcctaagatttctaaataatcaaggaaaggagaataaggaaacctctgaagacctagatcttttggtaagtatccagctgcttttacgtctgcaaattccatttagtattggtttggactggaagtccagctgtccctctccctccacccccaaccttaaagtgactatgactgaaccttaacagcattataataccttttttatagtgaaatatttacatgattttaatcttctaactttggaaatcaattgttcccagatagaagcttgcttattttgccatgccatgtaaaaatgaaaagtcattcaaaagcaatgagttttaaaactttttttcttgtaaagatatgctaaggtgtaaacattcatgggttttgtttgtttgtttgttttttctgacaagtttggcagaataaaccatgcaggaagcaggcagtcaacatttaatgtatatttattagttcctactatatctgaggcactgttcttcaagggttaaacacaagatttttctaccctcacagagcttatatttgagtgagggaaacaatgaagaaacaagataatttcaaatagaggtcctataaaaatataataatatgagagaaaatgatggtgattcacattacatgacctaaggtgggaagatggaatttgagctgagatctgaatgaaagccaccatttggaatgtgcagagagaggatgtggaaatcttaaggggcaaataaaaggaagaaatgaaaaaaagtacaaaagtatggagaagaatattgtggaaggcaggatcaaggtaggcagattcaggtaagagtgggaggtaagctgtggcctggtgtgaggtgaggttggagaggcaggcagagcccgtgggaaaggtaggatgttgtacatcaccataagcagtctggcgaattctacgtgaaatgtcaggaaccagtgaagggtgttaagcatagaatgacaatctaattttttttaacagccttattgagatagaatttacatatcacaaatttacccatttgaagtgtgcagttcaatggtttttagtgtatttagagagctgtacaaccatcactgtaagctaattttagaacctgatttatttttaaaaggatcattccggttcttgtgtgagaatgggttatcgaagggcaaaagtagaaaggacaagactcattaggagatgagagatgttcaatgtgaccaggagaaggtatgcatttcttcactcccttgtagcatcatcttccagctacctattgagcccctgtgctataccaggccacgtgtgaggtgccacatcttccatggtaaagaagacagatatgacccctgccctatgggagcatgcagctgcaagactgtgtgcaccacaaacttagcccttccagctttaccactgggtaagtgatgtgatttgaagaatagagaactcaatatatcaaagtcagcatatgacaaatatttctcacccacctatgcccacagtgaaaaagccccctgtgattccacccaacccttctgcccagaggctagacccaggattaagtgtccagcttgggcatgcatggcctatgccagcaggggcacagcagaggtctgcacacataggaagatagatcaaaggcccccttccatttctcctctccagagtgttccagtaagaacatccccttctagctatttcacacatggacaaccaagaaatagtcatttacagagcattttgcatttgtacaatttcactcgttatttctcccccagtacctaatgggggctgcagcgtgtactctgttcgtggttaaattctgctgccagaagtttcctccagctcctgatgccccgaacccctccctccagcattcctgtggctcatcttgcaaactgattcaaaggtgctttgttgcaatctgatctttcaggacacatactgctataaagcttttgaaattttagtcagagcaaaaaacaaaagcaaaaatataagcctaaacatcccctgaggggaaaataatgaaggagctcttaagcactattgcagataatgcttaattttaagaagacatgttttttttaaaagaatgtggactacttcctggtttagacttggaagggtgtacgtgtccagaaatttatctatttcttctagattttctagtttatttacatagaggtgtttctagtattctctgatggtagtctgtatatctgttttggtaccagtaccatgctgttttggttactgtagccttgtagtatagtttgaagtcaggtagcgtgatgcatccagttttgttctttttgcttaggattgtcttggctatgcaggctcttttttgatttcatatgaaatttaaagtagttttttctaattctgtgaagaaagtcaatcgtagcttgatgggggtagcattgaatctataaattactttgggcagtatggccattttcatgagactgattcttcctatccatgagcatggaatgtttttccatttgtttgtgtcctctcttatttccttgagcagtggtttgtagttctccttgaagaggtccttcacatcccttgtaagttgtattcctaggtattttattctctttgtagcaattgtgaatgggagttcactcatgatttggctctctgtttgactattattggtgtataggaatgcttgtgatttttgcacattgattttgtatcctgagactttgctgaagttgcttatcagcttaaggagattttggactgagaagatggggttttctaaatagacagtcatattatctgaaaacagaaacaatttgacttcctctcttcctatttgaataccctctatttctttctcttgcctgatttcccgggccagaacttccaatactatgttgaataggagtggtgagagagggcatccttgtcttgtgccagatttcaaatggaatgcctccagttttttcccattcagtatgatatgggctgtgggtttgtcataaatagctcttattattttgagatacattccatcaatacctagtttgttgagagttttcagcatgaagggttgttgaattttgtcgaaggccttttctgcatctattgagataatcacgtgtttttgtccttggttctgtttatgtgatggattacgtttattgatttgcatatgttgaacctgccttgcatcccagggatgaagccgacttgatcatggtggataagctttttgatgtgctgctggattcggtttgccagtattttattgaggattttcacatcgacgttcatcagggatactggcctgaaattttctttttttggtgtgtttctgccaggttttggtatcagggtgatgctggcctcataaaataagttagggaggattccctctttttctatagtttggaatagtttcagaaggaacggtaccacctcctctttgtacctctggtagaatttgggtgtgaatccatctggtcctgaacttttttgcttggtaggctattaattactgcctcaatttcagaacttgttattggcctgtctagggatttgacttcttccttgtttagtcttgggagggtatatgtggacacatagacacagggaggggaacatcacacactggggcctgtcagagggtgaaaggctaggggagggatagcattaggagaaatacctaatgtagatgtcaggttgatgggtgcagcaaaccaccatggcacgtgtatacctatgtaataaacctggaagttctgcacatgtaccccataacttataataataagaagaaagtggactaaatattctttattttcccttagttggttctttgctcaaagaaaaatttgcatcattgttttggtggatttggtagacctgtttaattaatgtcagacctaatggtttaaaagatcttggagcaaaaaggtgtaataccttttcctcactcattttgaggtccacagccaacatttctataggaaatacaggttagcaagagaaaagcataacaaactcaatcaagtttcatgtgacactggagccttcagaaatgaaggcccaaagacccagggaaaattgcatttttatgcttaggttcaatgaagaatggacagccatgtagaaatgtgattggacaaaaaggttatgctctaacggtaataaacagcggaccccagcaaggcctgtttgttcggattcttcttggcctcttcatacgggattttttccctgctgggtgtggggcaagacccttctggaatgagggtcttatggcctattttcagaggaggtaggtcagagaatgacctctcgaggttttacggcttgcttcgggagagaggggttctagtttctatgacccgctttggagaagagggatcctcattcccatgacctgcttgggaggaaaacgggagaaggagaaaggagtgtggagaaggccaaagggaacttcttgcttccgaggtccttcccatcttttacagttcaaagtactcagcatgccaaagtgtcatgctttggagtatagtgttccgagccttaacaatctttaatagctatacatgattatttttatttttatgggcaatttctatttgtttaagaaatacaatttttttttcattacatgtaatctcaccacccacaggtaacaatggtttacattgtgatatacatccctctgggcttttttctatgcctatgtgtactgataaaatatatgtgcaaaaatggataggtatgtctcagtggctctctgtgcttaaattagtccaaatggttattgttagatgcatatagttgaaagcctcaggaagcaaagactgtatgtctattttttttgtattcttcccaggtacatagtaagcctttgaacttgatagatatatgatcaacctgagttgaattaacaaatgaatgtataaacagacaagccataaaacaggtacttatttaatgtcactattttaataacatttgcttctttaaatgcttccctctgtgatgagagtaatgacaaatatataacacatatttatttcccttttctttttgcatcctggcttattgatttttcagtctaccatttaggaggatatattgatataaggaaaatatttttatgacagcttattacaagagaaaattttaaaattctggttactgatgtaatgttggatgggtgaactactatagctttatgtctccacgatgtatgagggatattttcattcatctcttaaatgcattctgcctttagtgtaatagtcaattgattcatgtagtttacaaatgctttcacaagagaataatagaagggcacaggccaggtgcggtggctcagcctgtaatcctggcactttgggaggccgaggtgggcagttcatgaggtcaggagatcgagaccgtcctggctaacatggtgaaaccccgtctctacttaaaatacaaaaaaaaattagccgggtgtgatggcatgtgcctatagtcccagctacttgggaggctgaggcaggagaatggcgtgaacctgggaggtggagcttgcagtgagccgagattgcgccactgcactccggcctgggtggcaaggcgggactccttctcaaaaaaaaaaatggaagggcacagcaccatatctaaatgccatagttatttatcataaattgttattctctgagaattctgggagcttgagattatcgtccatcctggttaataggacactggtaggtgttatgctggtgctgtcgagcagcaaatcatttaaagccaagtgctacaatttgctggctgccatccagttcactgagtaactaactaagcagtcacacatccaaccccacagtggggtgctgtgaacatgtatggaagccccatatcttcaaggaggtcctaccaggaccacaggttactaaaacttctccgatagtgcccacggtgaacccgtattattgttcctctatcaggtagctcaatatatatgaaaagatagtggaatctgctaggtgatacaggtgagggaagatcctttgatttgagttgatgacaggaattcagctgagtcatgttttaggatgcaggctcatacctagaaccatcttgaaagtaccatctgggagcaagagggcagggcatggatgccctgttgaacatgggctttgaggcgaacagacctgggatggatatctagtcccagagtcgtgtgggatctagggctagaaacttcaccttcctgtattagttttctattgctgcataaccagttaccacatagctggtgtcttataatcacacatttattatcttgtagcttcaacagtcaggatcagcttagctggatcctctgttcagggtctcacaagcctgcaatcaaggtgtcggccagggttgtgtccatctgaaagcttgactgggcaagaatctgcttccagactcctgtggattgttggcagacttcagttccttgaggtcatgtgactgaacgtatgtctgaagcctgtgccttgttgtcagttttagctgccctgaggttcccatgatccttgccacatgagcaaggatccttgccacatgaacctctaatatggctgctttcctacctcaagagagtttctgactccagtatgctgaaatggagttgtcttgcattgcgtgaaataattatggaagtgacatctcatcacgtttgccatattctcttagagtcaagtgacaggtcccacctacactcaggagaggggattacacaaatgtgtgaacagcagaaggtagaaacattgagggttatggtacagtctgtttgccacaatccctgaatccattctttaaaaagttggtataaaaatacctactttagagggttgttatgtgaattcaaaacaagataacatatatcgagtgtttacgtggtacctggcacatagtgagcattcaataaatgtcactgatgatggtaaagatgataatcatggtgataaccagtggatatcctgataaatgcctataatctccttaaatcatatatgtctttctaaggactcaccacaatatgaggaatttcaagttttgaacttgactctctcaaaggataatggtcaactcagttatctacatgacatggagaggagggtgatggaattgattatctaaggcaggatataattcaggaaaatatctaacttgactttgtaataaagattttttctttccctgattgttctgcgcacacatattattccatatcacagaggtatgctaattaccctaatttatttactttctccccattgatggactcttagtttgaatctaatttttactattaccagcaatgctgcagaggacatccttctagacatattcttatgctcttttgtgtttttgtaggaaaaagttgtacagccatttatagacagcttattacatatccgacattgtgttatgtgccaggtgaataagatatatatggttccttccctcatggagctcacagccattaaaattacatgtattaaaagaataattttgagtatggggtgtatattataggaggacataacatagtagggaggagggagaggtgaggtcacacccaagcacaggaagataagcaagattttgaggtcaaatgagaagagttaggccatctctagaaaagaagtgaaatcttaggatctggggaatcagaacttggacaacattggagccaagttcctgggatcttgaaattactcttaaaaaattcacatgtacaaatctcagactgttaattcagaaataagattgtatttttctattagaaaaattattttaagatcccttatttttctgagtagcagaaacttaaccttcgtcaatatgaggtttcctgtctttttcccagtgttgggtctaagcactggggtcttacatcatgccaagacattcggtatatggaattgagatgaagaggtatctggtctttagtagtcacctagtgtattagtctgttttcaagctgctggtaaagacatacccgagactgggcaatttacaaaagaaagaggtttatgagccaggtgcggtggctcacgcctgtaatcccagcactttgggaagctgaagcgggtggatcacctgaggtcgggagtttgagaccagcctgatcaacgtgaagaaaccccgtctctactaaaaatagaaaaaattagctgggcgtggtggtgcttgcctgtaatcccagctacttgggaggctgaggcaggagaattgcttgaacccgggaggtggaggttgcagtgagccaagatcgcgccatcgcactccagcctgggcaacaagagagaaactccatctcaaaaaaaaaaaaaaagaaaggtttatggacttacagttccacatggctgaggaggcctcacaatcagggtggaaggcaaggaggagcaagtcacatcttacatggatggcagcaggcaaagaaggcttttgcagagaaactctcatttttaaaactatcagatcttgtgagacccattcactatcaagagaacagtatggggaagacctgccccatgattcaatcatctcctactgggtccttcccacaacacgtaggaattatgggagctacaagatgaaatctgggtagggacagagaacctaataatatcattctgcccccgacccattccaaatctcatatcttcatatttcaaaaccatcatgccttcccattagtcccccaaagtctcaactcatttcagcattaactcaaaagttcacagtacaaagtctcatccaaggcaagtcaagtgtcttccacttatgaacttgtgaaatcagaagcaagttagttacttcttagataaaatgggggtacaggcattgcataaatacagccattccaaataagagaaattggccaaaacaaaggggctacaggccccatgcaattctaaaatccagcagagcagtcaaatcttaaagctccagaatgatctccttcaactccatgtctcacattcaggtcatgctgaagtaggtgcccgaggtcttgggcagctctgcccctgtgactttgcaaggtacagcctctctcccggctgccttcacaatctggcattgagtgtctgcagcttttccaggtgcacagtgcaagctgtcagtggatctaccattctgcggtctggaggatggtggcctttttctcacagcttcactaggttgtgccccagtaggaactctgtgcggtgggtcccaccccataatccccttccgcactgccctagcagaggttctccatgaggactccacccctgcagcaaacttctgcctgggcatccaggaattttcacacattttctgaaatccaggcacaggttcccaaacctcagttcttgacttctgtgcacttgcaggctcaacatcatatggaagctgccaaggcttgaggcgtggaccctctgaagccacagcctgagctgtacattggcccctttcagccatggctggagtggttgggacacagggcaccaagtccctaggctgcacacagcatggggaccctgggcctggcccatgaaactatcttttcctcctaggcctcctggcctgtgatgggaggggatgttgtgaagacctctgacatgccttggagaaattttcttcattatcttggggattaacatttggctccttgttacttatgcaaatttctgcagccagcttgaatttcttctcagaaaatgggattttcttttctatcattgtcaggctgcaaattttctgaacttttatgctctgcttcccttataaaactgaatgcctttaacagcacccaagtcacctcttgaatgctttgctgcttagaaatttcttccaccagataccctaaatcatctctctcaagttaaaagttctacagatctctaggacagggtcaaaatgccaccagtctctttgctataatataagaagagtcacctttactccagttcccaacaagttcctcatttccatctgagtccacctcagcctggactctattgtccatatcactatcagcattttgggcaaagccattcaacaagtctctagggagttccaaactttcccacatttttctgtcttcttctaagccctccaaactgttccaacctctgcctactacccagttccgaagtcactgccacacttttggttatctttttataagaaccccactcctggtgccgatttactatattagtccatgttcacactgctgataatgacatacctgagactggacaatttacaaaagaaaggtttattggtcttacagttccacatggctggggaggcctcacattcatggcagaaggcaaggaggaacaagccacatcttatgtggatggaagcaggcaaagagagcttgtgcagagaaactcatgtttttaaaaccatcagatctcaagagactcattcactatcaagagaacaacatgggaatgacccactccatgattcaatcatcttccaccaggtccctcccatgatacatgggaattatgggagctacaagatgagatatgggtggggacacagagccaaaccatatcactagtcatgctggcatctgctaagatctccaaaatctgccctggaccttggccactgatccacataggtcactgctacaccatcccttgttctaagtcaggtcgatgaatgttccttgttacatctatacttctgctgaatgcatagaattcctgtgcttccctcaaccctaggacattaagtggagctaaaaccctgtggtacttcagagccactcttagcagaataaagtcatctttttgtcatcactctgtgctgagttaaggggaaactcttgcaaggctgtttaggttccctctgtctaggcacatcctgcagtcatttcttctctgaggttgtggcacctcttttaggctctgccagggaagagagacacacattactttgctctgtaatcccataaaccttcatgttgttctccaggggttcctttctgggctcacttttccctcatacattctctcttcctcaattctggaagaacttaatttaattggtggggaaggatagaaaactttgatataatgcatcactttgatctaactcatcacatatgttctcaaatttattgcctggtttccaagattcaaaatctgagagcaggaggcccctttcagggcccttttgccccactgccccctcccccaagcatggaaataaaggaaaattttgagtcctctcaagggaaattccaggcacttggctagccttgagaaataaatgagcaacctgataagcaaaaaggtaataataacttaaaacaatagccacccaagtaagttagagacacagatatttggttccctataaaaactaaagataacatcttgacatatgtccctgagttatttttcagaaacgcagactcccaccagatggaaaatgttacataggctgtcacacagattgaactctgactgccattccttgttctaattttcttcctgaggggcctgaagaaagtcatgcacacagtccaaacctgaacattcctttctgtggaccccaagtttttaagacacagctttattttcttaaccaattgcaaatcaaagaatcactgaatctatttatgacctataagccctggcttcaacatatcctcctgcctttttgagccaaaccaatgtataacctccatgtattgatttacaattttgcctataacttctgctttccagaaatgtacccctgcccttaaaatctcttgctgataagccatggggagtttgggccttaagcattatctgaccaattctccttgcttggtatcctacaataaatccttttctttctctcattgaacatctttttttataattaatgaataatttattttgtttttgttgctgctgtttacctacagctgtttatctcacagcaaatcttgatgtcagcatttggctttgctgtgccaagtgagcagacccaagttcagttcaataacaaatccaaaagcctttgttctctgctattctttgagttatctattccttgaggcaatgaatgactgaatgggggtagggatgcagaggaagaccaagaggtacaaaaaatatatagaaaatttttaaaaaatattttacaattatttaccaactacaaatagcactttttatttattagtgatgaggttcaagacacatcaccccaatatatgagtgtactggactagaatatatcaccccaaaatatgctcctttagcataaggattatgttgatctaattattttaagaaacagcagacctaggagaagctctgaaaacaagagtagaaattacacttttgtaaggaaaatttgcatttacaaaggaaatctccaatttaagggtgttttcctctctgcaccaggaagagaaggatgactgtacatcattatacatgcctaccaatggagaagacactgacttaaatctgcataacaaacctaatgctgttttatggtgttttgcctggccatcttggcaaagctggaccttccccaccccgctcccttttttttgtttcggtagatggaattcaaaccacctcttagagaattactcattttccctgtgtatctcccgtggtataaatgagacatacatgtttgtttttctgtggttaatctgtcttttgttataggaattttagttgtatcagctaaaaatcatgaaaagtagaaaaaaaattattttttctctgctacattagacatgcaataaatatgtgtgtttgaggctgggtgtagtggctcatgtctgtaattccagcactttgggaggtcaaggcaggcggatcacttgaggtcaggagttcgagaccagcgtgaccaacacgatgaaaccttatctctactaaaaatacaaaattagctgggcacagtggtgcatgcctgtaattccagctacttgggaagctgagtgttataaataaacttttggcgccacaaaagaaatagcactcaaacataaatttaattttctcagcaaggcaattttacttctatagaaaagtgtgactcgtggatggagcaatggtgagagcacacctgaacaagggaggggaagggctttttattcctgacacaggtagcccctactgctatgtcgttcccttattggctagggttggaccacacagtctaagataattctgattggctattttaaagagagaaggagaacaagtcggagtggcggggtgagtagtttggtgggaagggcagttacagaaaagagaactcaggatgattcaggtcagagcaggtgaccagggatgactcagatggaacagatgaccaggggtgactcaggacagagcaggtgaccaggggaacagatgtgaactgctgattagaactggtggaaaaagttgtttactgaaactatgggcgaggagaatgaggaagttaaactttaaaatggagaacaaagaactgaacatactgacatactgattctttgaagagaaatttagaactcactgtattcaacatgaggcaggagaatcacttgaaccctggaggtggaggttgcagtgagccgagatcacgccattgcattccagcctgggcaacaagagtgaaactcggtctcaaacaaaacaaaacaaaacaaaacaaaacaaaacaaaacaaaacaaaacatgtttgaatctgcttaacacaacatttttagacggacctcttttgatgttcctaaatcaggctgttaaggactatcttccatgggaaaaggtgacttaagagtggcaatcactgatacagtaaagttctgctttgctgctttgcaaaactttgctttattctcattttctgggggggatgtatcctaagccttaggcaagaattacttaaatttaaaattacacttaggtacatgaatattcatagcagcattagccataatagtaaaaaactggaaacaacccaaatgtccatcaattgataaacgggtaaataaaatgtggcatatcaatgcaatcaaatattgctcaggaacaaaaggaatgaagtactgatacatgctgcaacatgtatgaaccttgaaaatattatgctaagtaaaagaagaaagtcacaaaggaccacatattatataattcaatttatataaaatgtccagaatagacaaacccacagagacagaaagtagattgtggttgcctaggaacatgcagagaaggagggatactgggattgggatttgtgttagtctgttttgcattactataaaagaatacctaaggctgagtagtttgtaaagaagagaggtttatttagctcacagttctgcggctgttcaggaagcacggtgtcagcatccgctctgcttctggtgaggcctcagggagcttacagttatggtggaatgcaaagagggagctggcatatcatatggcaagagaggaagtgagagagaggggagaggccccaggctcctttaaacaattagctgtcacgtaaactaatagagcaagaactcactcatcaccaagaggatggctcaagccattcatgagggttccactcccatgacccaaacagctctcatcaggtcccacttccaacattggggatcaaatttcaacatgagatttggagggacaaatatgcaaaccatatcaggtgttgatggtgaaggggtgctgtgtttctttttggggtattgaaaatattccagaatttattgtggtgatgggagcacaactctgtaagtgtataaaacctgttgaattagacaccttaaaagagtcacttgtagagtatgtgaactatacctcattacagctgttagaaaaatgtataccttggtggtcaaattgtagtagctagtggtggcttcagtttgcggagttagaagagtaaagtcaaatatgagggtttttatattttgggtaactttttcattacctaaaagtgaaattttctctttttgtggatcttaggtggaatgtaatgtaagggagaaaacctttctctctaccctcttaaggtttgatcattgagtctgggaagtaaatagacagtagatagattaacaggaaaaaacaattttaattatgtgcataggcatgggaatctcacaaaagatgagactcaaagaagggctagatgattaaagtttatatagcatcctgagctacagaaaggaattggggcttggagcttaatttgggggtggggcatgacacaaattatgggagggaaaggagaggaaatgcatggtgaataaaagttgtcttgttatgcagataaacagtctccagagtaataaaggttgtcttggagcacccctcagaacaggtgatagtttgtgataatgtctgggcttggcaattaccttcagtctgttctcctcctgtgatacagttaatttttcctaattaatgagattcctggggaggaaactcatggcaattgagtgcctttttggaagatctatctttaggcagacgaggcaagttcagagaccacccttccctgtgcttttgaaacaggggtgagagacagcagggcagaagttcagggaggctttttggttctcccttagttcaaagcactctgcatgaaagccccaaactttggggtatcattttcagagccccaacagtaaacttacaaatttgcctatttgtgtagacttgcctcttgagggtcagtagtcagtatttttcttactcagtgaaatttcaaaatttacagaattgaaatcactcggacttaaattttaaaatgtacttgtgtaaagaagatacatatagtaaaatcctttgaaagcagacattgaatctttctgaaaaatgataggacatttgcagtttttatgtgatgatctagttaaatccatttgatttcttccccctgttctgccttctcttactgtccattcctcttctggtagaaagagttgactgcctgtgtacaggtggcagagttgttttctgttcatcagagtcagtagtagtaaaattcagttgctggattagccaagtgtgctctgaattctgacctcttcaatacaataacattttgcatgactaagtctgtacagtttgttccaaaacattaccctgcaaagcagtctgcaaagcagcttgatccatgcttggacagccatccccagcttggtcctccaggtttgtggacaaggatctgggacactgagggcttgtagagagtagatatggattggattaagcacaaatggcaaccctagactacacaggaaagtcgtagtcggccacaccttgggcttcctatgacagcagcatatcagtgctaacgagccagggcttgcaagccaaggcacaccaatgcatttgcaaactccagagtcaccataagaaagtcatttattccaacgcttgtagagagaggctgcttgtctctaacagtatatgtgcagtgttgaaagtaaatctttagataagttaaatttaaccaaatttaattgagcgaagaatgacttgtcaatagggcagctctcagaaccagcagaagttgagagaactctgctccccgatatgggctgacagcaaatgaacagaaaatggaagtgaggtacagagacagcttggttggttacagctaggtgtttgctttatttgagcatggtctgatcagttggtaacctataattgattggaggtttgctgctgtgttttactgctgaggctcagctattagctacaaaaatatattaaattagctttcagtcagttcataccaagttaggttgcatgcagttcattacatagggactcaaggtatggagtcagcctcagatcaagtttagattaattaaacagtggagagagggcagatgtcagtttcagaatcatggctgattggaaaatgttttccctttctggactttttgggtagggagacctttccttctcagatcctccaaaaggccttcctatctccaccaacaacaactccaagaaatgtctttttatttttaaatacatgctcagagaatacagagaatccaaaagaaggaattaaaaaaaagtaacaaactaagacatagtcattgtcactactttggtatatgttaatgctatctaacagaagtagaaggtgaatgacaaatatgagtcatatatttaattaaaaaatttaatgtagccaggtgcagtgctcttgcccataatcccagcactttgggaggccaagacgggaggactgcttgagcctaggaggtcaagaccaacctgagcaacatagtgagaacccccagctctacaaaacaaaaatactgtactcccattaaaaaaggtttaaaaaggtgaaattaatgttaataatactttaaacttgatatatattattttatcatacaatcaacttaaaaattattattattattattatttttgagacggagtcttgctgttgttggcccgggctagagtgcaatggcatgatcttggctcatggcaacctctgcctcccgggttccagcaattctcctgcctcggcctcccgagtagctgagtttacaggcacctgccaccatgcctggctaatttttgtattttttattagagacagggtttcaccatgttggctaggctggtctcgaactcctgacctcaggtgatccacccacctcggcctcccaaagtgctgggattacagctgtgagccaccgtgcccagcaacttaaaaattattaataggatattttacattctttcatactatctttgttttttattattttattttattttagagacagggtcacccaggtcggagtatactggtgtgatgatagctcactgcagctcggacctctcaggcttaagcaatcctccagcctcggcctcccaagtagctaggacaacagatgtgcaccaccatgctgggctaattgttttgttttttgtagagacagggtctatatgttgtccggcctctttcatattgtctttgagacccagagtgtattttgcatgtacagcacatcccgccatgtttccaactgaggtgctcaatagctgtggctggcgcctattgtactgaccagcacagatggatattgttgtgaatctttaccccaaatttggttcagatgctataccaaaggagggcacacccaggctttctgagcagcttgcccaggtgtgggtgtggtgcagagaggtaagagagagaggcaaggcttaaaagctgtccacagttacacatcaaaaaaaaggagtcagactctatatatacattatattaatatttatatctatctatctatccatccctatatcagacctcaaggaaatatattcaaaactacatgttgaaaaaattaagcagagagaagtagatgggaaggtactaaaaatgcaagacttagcaaaagaaggctgtatatatatagcaaaaggggacacacaacaacccctcccactagcaaatgcagcccaatcattgcccctaaaacagaaccttgcacttgcttctcctttcctgaaatgcgcctcctgccccaaggcacacagcttctccctcacttctttctgttctctgttcaaatctcaccacacctacctcttctgaggggctttccttgttcatgctatctaaattagaggttcctctgcccctgtgattcttaatgttactgcaaagcagctaccacttaaagaatttgtagtctatctcccctgaataaactggaagctcaaaacgggggagttcaggtctgttttgtctgctggtttggccccagaatttagaaaagaggccggcacacagtagattctcagtaaaatagtgttgagtgaatggttgcttaggagaaggaaacagggagggtacttggaaaaaaggagcaagaaggccaccattggtgagaataagtgttttataaaacacaggttatggttttccttctttaagaaaagtagttttgttttcaagtgccaagaataacattaggctactaaggatttctggactgctttggggtttgttttaatgaatagatggaaattacatctatttagcattaatttttatgtgtaagtgggtacacccgaattgaataaaagcagttctcttgaataattaaaacatcctcttcaccctgcaaagcatttagcacactcctctcccaaaaattctattaatggcaactaaaatcataaggtttaaatgcaaaataaagaaggcatttttctttatggtggcacagaagtgaatacctcaaaaccgggcagacccgagagtcagataccaagggttctgtggagtcaacatgatggtctctgataacatcaaaagttaggaatgttttactaaaaagaatataggaagaataaagaattcttgtttacagtagaattcaaactaataaacatagaaagaaggatagaaatagaaaatcaccattaggcgaaattactgttgcttgcaagcaagtatcatctacgtatgacaaaatctgttggtagaagtatgatgagaaaaagggtactaacatagtcttaaagggtctctccacaagatatattaattccaaaagaaaaaaagagtactacaggggagaacactggtggacagacacaacctaaacaaagtgatcaaagttaatttcaccagtactgagagacattgatttcatgcccctcctgatgagattcactgagaagggcacagtattactgctgtaggatgcttgacaaaaatgtagaacccaaatttaatcatgaagaaacatgagacaaatgtcacttgagggacattttacaaaataactgctcctagctcttcaaatgtgtcaaggtaatgcgtggttaaggaagaccaaggaaccttcccagacttgaggtgattatagggcatgaaactaaattcagtgttgtgtcttagattgtatcctggacgaggaaaagcacattggtggaaaaattagcaaaatttgaataaggtctatctattaggtagtagtattgatcaatgttaattttactgttttggataactataccaagtttatgttaacattagagaaacccggtgatagtaatatgggacttctgtgaactattttggccatatttttctaattctgaaattaattcagaatgaaaagttgaaaagaaagtatctttagttggcaatcttctgggaatttgaacaggaactgccaaaatgggagtcaggagacccaggctcaagtttgagccctggcattaatcctggtgtttgggcacggcaccaaactctgtccttctgttttgtcatctataaaactgtgttctgcagaatttaggagtgttgagaagaggccttagggctctcagtggtgaataggggacagggaatgagtgggtgtgaggctccagccagagcagctctgcttttgcctactttatatataggacttcataaaaaactaacttttaattatgcaaaaaatatatattttccttgtaagaaattagaacgttgcagatgcaactaaagcccctttggccaccatactccccaattcctgtgtatcttggaattgcatttaagatttccatttgaacaaagggaccctggctcaaacaagttgggggaccattgggctggttaacccttaaacaccccaaacactcaataaagaggagtttcagggaaatggacaagccatggctggaggatgttctacaaggttgagcagaaacccatgcaataatttgctgaaatagggcattgctctgagtgctgtgattccagggagatgtcactgctgtgtgctggctgtatgcccagcaaagggctggtggctggaaggacatagctttctgagttaggactggaaggcttctgtacatgtccaaagtcaaccttcatattcatggggagggaaaaagaagtgggctttaggattgcctctccttgttggcctgctctgagaaaaacaatcgcgggagggtgaggcgggagaatcgcttgagcccaggagtttgaggctgcaggttagaagctgccgtgagctttgattgtgccactgcactccagcctgggcgatggagcactgggtcctgtgagccttgactcatttaacccccacagcacccagtagatggtggcactattagcatacttgttttagaggtgaggacacacacacaaagagataaggaattgcctaagagcaaaaagctggtaagtggtgagcccaggtgtgagccttgcttcaggatcaagtgcgcacccctgtgctctggactccttccaggtgttgtttctcttgctggcattttaacttcattacacctatctgtatgttggtcgtgggaaggaggaagctcaccgaacactgtggcttacccaagatttgtccctcgactttccctcttcaccaaaccccagagccactggcggaatgttcagttccttggaatcccacatgcccgggttagctccttttgcaagcagcctgatggatagaagtgaagggatggtgctccttatgaaaggagacgggggagcttagtgagcagcggcagggccctgcagcccgtcacacgctagcatccaccgggttgagtggctgcgcacgaccgcggcgggcgggcgggcgcgctgccggaacgctctaggcctcctgcggaacccaggcctgcgtgaaggtaaatgcaaatcagctccgcccagcgcttcccgcagaaggagggttttctgtgtgcgcgtctggtttcctccgccttcagccagaatgctggctttatttttgcggtttatgagcttgagacagggaattcatttccttggtataatatgaccctctggagaaagtcttgtccagatatattttgctcccaaacgccgccctagaagaaggactacactgaaatgaaacggagatgattaaagtctgatttataggtaaggtgaattggtaggattatgccaaattcattacatccagagaaggtgaaagggaatgaaagggctcctcccgggagatggaaacctttgtaaaaataaatatttatggtgcacatacctttaactcagctagtagccaggttatattttattatattcaccaccatttcccttttctgtttctcaccaggctgtacaagccctgaaagcaagaacggggttcacggcatcttgatacccccatgtggggacgttttggcgattttatttacaagaaagggattttacaccggagaggcttttaaatatgctaacagactggaccagctttctcatccccactggctgattaatgattcctccatgccaacccggttctcagagacaccaaggccaggtaaaaaccaccccttcatcccctaaaccttgcaagaagcacagggtccagaattatgcttctttcaggttctaaatagcacaataaaactaataacaataagcttttagttattagatcaggtacattttactttacagtaagcttttacttattggatcaggtacattttaaagcaatttttgaacattatttcatttgatcctcacaaccacactatgaggtaggtactatcattccatttgaaggatgagaaaactgaggctcgaagatgttaaataacttgttcaagatcacagctagtcagtggacatagctgccattcactgagtgcttcctgtgagccaggcacggtgaccatcacattaaaccaattatttatttcatgcaatagtgcccttgatccttaggaagtggcctccagtgcttagaattccaagcatttggtcctctggagatgagaaaccatgggaaggcaggggctcactcacccctgtatccaaaaagttgaggatggtgccaaggacagagacggtaccagggactccaaaaatactgaatgaaaggacagtagaggtgctttcctgtgggatccccaatctctccccgccttcaggtgagtcctgctgatgctcaggctgcccttggaacagggaccttggccatagtttccttatctgtaataatgggatgagaattcctcctgcacagggttgttagggacctcgtgaggcagcttctatggctgcctttggtgcttagttttctcactttcttcttgaacatgggagtggggagacggactcctaagggtatgacacttgaagatttcaggagggggcctgcaggtttatgtcctcacttgttttacacctcacagaggtcagcgaagcagggtatcaccaaagccccacctgatgtctctggaaatcgagtactccgtgtcttcaccaggcccatgccagctgtgaggggcagaaccaggttttctgacaccaaaccccaggtttcttcctgtgctggcatgggtcctttttctgacttggccagcagcctctcatagatgggggtctgattaaatagttctggtgatgggtggagtgatggttgcacaacaatatgaatgtatttaatgccactgaactgtacacctgaaaatggttaaaatgttacattttatgttatgaatatttcaccacaataaaaaaaagaaacaaatatggatctgtctctctcacatgtcaagaaatctggggtaggtagatacagtggttggttcagctgctccatgatgccatgaggatctggagtctggcttttttcttttcttttctttttctttttctttcttttttttttttttgagacaaagtctcactctgttgcccaggctggagtgcaattgtgtgatctctgcttactgcaaactctgcctcctaagttcaagtgattctcctgcctcagcctcccaagtagctgggattataggagtgtaccaccatgcccagctaatgtttgtacttttttggtagagacggggtttcaccatgttgaccaggctggtcttgaactcctgaccttaggtgatctgcccacctcagtctcccaaagtgctgggattacaggcatgagccacagcgcctagcctgaagtctctagcttgagtttttgcatgatggctttcatactgggcacaaggtgtcctctgaagcttctcgagatttttttctgctcaagagaggaggatggaaggaaagggtgatgctagacatggctctgtctttcatcagaaaagccaaagcttctcagcaaccctcccagcagaattttcttatatctcattggccagaactcagtgttttggctttgctgggcaacaaaggtggctgaaaaagtggtcgctaaacttaccaacatttagagctgaagagggcatcggggagaaaacagttgggaatgagtattgattggaaaaccagcaggctgtttccaacaccctgctcaaggtcacaagtctgttatgtaaccatagttgggactggagtctgctcctctgattcccagtcctaagatctttggcttagacatttagtacattttgtagtggctagatttacaataaaaaggacagtcctggagactatctttaaagaagaaaaactctgcattgcatgcactgaaattaatcgaatgctaagaggtcatgtcgcaaaagcactgggcatggtgggagccagaacatctcacctctgccccaggctggccagaaatttggggaaaggtcccagttctcagtgcttatgaaatgtgattagttatttattttttaaaaatctggttagtgttgttcattaaatgtccgttaagtactttggtaactgcagatgaaagaccctgtagggggacaaacacttgttattaacaaccatatgctgtcaagtgtgggcttataacacgggaccatatgctccaaaggttggcaaagaatgacagaagccacccaccattcctccaggccaggagcagagtggcatagggctccaggggacactgaaaatcaggaatgtaaacaaacacccctattataattaccctgccattgcaaggaagcctgaatgtgcacacttggatttttgggatagcaggaaattggactgcattccctctgatcccaccatctcctccttccatgggaagcaccaaggggaatttgcaggccctgcccattctttagcccaaagttggcaccctctcttctctgatgagtcttcctggatggtgctgggttacacagatccttctttttcattctcaccccaggctaccatatatcctgaacattttagcgtgtaatgatagtgaagttaacttttcatcctgccttataagcagtgttaggagtgggcactgtttgggagacacaatgcaaggctttttgaaacttcccaaccctgagggctagcacatgtccatatatacggcaaactctcaataaatactagagctggacctaagagctgagatgtccatggctgtaccaggttagagttttatttcatgattcttgggataccagtagagtcgattccaggatagagggtggaataagtgagagcttccacccctaaaaaaggcacaatgcagttcagtgcccttgcaaaggatccttccttgtcagattacagggacatcccctgagctcaggaagacactgactttggaaatactataaggggaaagagcaactctgcaaaatttggaatgggatcacttcaagaaagggcaatgcttaaatgataggggaaaaaatgcacccctggtagacttgcaagcagagtactcaaatcagctgagaatgcccaaaatatgattacaaagaagagtttttattagttcagcctcagaatgcaaaaataaataaataaataaacaaacaggaaacaaatgtaatcactttacagagcgcacatacattacttaaaagtagcaccttcatggagccatattttctggtcataattgtgtatcaggttcattcatgctaatgagaaagggattccagattttctttgcatctgtctgcttctcacagggctgttaagaagccacctgccattctgacaatttcatgtccttagccataactacttgtcctctctcttgaatcttaagatctttttgccttccagacacttacggtgtttctgtgtcatcctcctgtgtcttttagagaggtgggggtgaggactgccatggaagctaaagctgaattttaatttcaatcatttttttttttgagacagggtctcattctgtcacctaggctggtatgcagtggcacaatcacggctcaccatagccttgacctcctgggctcaagagatcctcctgcctcatcctcctgaacagctgggaccacaagcatgagccaccacgcctggctaattttaaattttttttgtagagacggggtcttgttatgtttcccaggctggtcaatcatttttttctagcccttttaaaattcaggcatccaaagattaaacttgcttagaagtgtaagtggccctaaattgctttatcaacaccatctccaggaagtcttcacagacatgggaactagcatcttgttctcctggatcttctcaacaggtttgcattgtcaggtttccatgtaagtatctcttgcgttcccatccatcacaagtgtatgatggcactggtatcagaacactgcattcttcctgattgtcataaaactgatgtacttgcagccttgcttgaaaagttgtcagtacaaataaaattaaattcacattttgcataatagggactgatcctgatggatcaggtcataagagtatgaaacattccatacatcctggcagacaaacgttaaataacagtaatatactaataaatacataaattacttaaatatttaaatagcatgaaggcccatggcaacttgagagctggaaaatctatacataaattagctgattgtttcaatgagcatttagcatctaactatacaaatacagcaaagatatcattgtgatcctaaaaaaacgttttaaagcaaatcagatagaaattatctttttgggtctattccgttgtgtctttaaacattttgcttaatatcttccacttttcctccaaattttcatcctggatcagaacctggaagagaatgccaaaagttgatgtggggtgacattgtaacagcaatgtctcttcttatttctcacaacatatgatcctgggcaactgggtttcagggatttcatgccagaaggcccaggccttccttatgtggcctggaatttggctggcaccatgcttgccagaggctttcttgagggttttcttaaaataatatctgattgtgttacttccttgctgaaaacccttcagtgggtttcagggcccggggcccccagaacaagattctgagtcctgcaagcttgcaagtcctccatgctctgcctcctggctacctctctcttttctttgcctttctctttaggaggccagaaccccggtctgttttctttcctgcaatatccctgtggccagcacagtgtcctacataacaaaggcaccaaataaatatctgttagtgaataaatgtatgtttctgattctggcaactgggtgctggccactccatccccctttcctctccaacacagcccccaatcatatccctgcatccaggtgcactgagagtgcaggcctgggctggcctttgagggcctgctcacctaactgcagggcacagatgcccattcgctccaagatgagctatagtagcggtcctgggcccgcacgctaatgctggcatttttgcggcagatgaccgtggctgaggtcttgtccgtgaagactctatctttctgcaaaagagaaggaaagctgtgaagaccccttggcaacatagtcacagggtaagctgagcctgtttctgcaatgcatactctcccaaaacaagcccatcttggtcttagggcactgtgcttgcaattcacaggggtgtgcatagaacttgcaccacctactggcagacactccacatgtaggtgcagcttttgtactttgtaagcccttgagggagaaatcgtttggcccagctttcatctttctagcacaattgccttgcctcaagaccccatggccactcacccagtcctgagctgatggtgagagagagacagatttgctctagccatccctgagatattgagaaataccatatcctgatcatttcatcagaaaacttgccttcaaattctggcactgctacttaatagctgtgtaacttcaggaaaatgtcttaggttctctgtgtctgtttcctcacttataaatagggataacaataatgcctacttcatagaattatagttcaaggtaaaaatcacgtcaaactcttagcaagtctttagcacataggaagcactcaatatcacctattagtcatacagatcttaaatagggaaagtacttgccaagatgtaaaataatatttaggtaaatatctattccaggatagcctccctacctaattattttcccagagagtaactagctcactgaatttctaccacatgctaaatgctatgctgaattagggctttgtccagtgattttaaaagtggggtgaaaggagtctggggcggtacaaaagggcctctggaaccttgcaacaggcaaaggaattctgctgtaaggtgaggaagctgggaagccaatatcttagcctctataagtgtagacattctgtttagtaaaataattttataatatctggaacagccaggagctatccattttgggggcgatatctcttgcctgttctatcattcattacatgcactcagttgaaacaacaattttaggcttctggagcccaggtctcctctatcaggactaattctgagtgccaagatcaatgaccaacatcagaggtagtggagtggttaggtgcatggcctttctgtctggcagattgagtttatgtcttggttatgtcatttcctagctgggtgaccttggtaaagtcacttaacctctctgagtcttcaatcacttgtgaaatgatgataatactactggctaccaaccatccttttcttggggttgggctactgtccaatgagcacgtagtgagggcagtgctgctaacacctacacaaaattcctgcatcagctacagctttactttaccttgccacagtttctggaaaaaaggaaagcctcttttccacaaaaaagggggtaaaaaaacaagaataacatcagctacctttgttgcgttaattttgtagattaagtgaaataaacatggaaaacccttggcacagctctagacacatagaaaagtgctaagaaaagtaattatgcatcacataataacatttcagtcaaagaaggatcacatatatgaccagtggtcctatattgttataatattgtatttttgctatatcttttctgtttagatatacaaaccattgtgttgtaattgcctacagtattcagtacaggaacatgctgtacaggtttgcagcctaggagcaataggctataccataaagcctagaagcgtagtaggctataccatctaggtttgtgtgggtacaccatatatgtttgcacaatgatatagctgcctaaagatgaatttctcagaatgtatccctgttgttaagtgatacatggatgtcattgttattatcatcattcatcttctcactttatggtgggcctccgtaaaactgaccaaggaatatactgcacctgaatcacttcttaccttttctctcttgctcttgccctggacctgaacgcagaatgtcagggagaagtaggaatgtggagtactccaggtgtcagggtactcccagctgacctccacctgccgagaattctttaatggcttcagctgcaagttcttgggtgggtcaggtttgactgtggaagaggataaacatgctttattttcctaataaggctttggagttcagtggttttggcttatgatctcacttgcacctttgatcagctgtgagtccactggatagttacttaacttctgtgagcacctggctggcaaatgtgaggcacctctgccgcaggtgctcacgctggtgcctcgggaaggcagtcattatcaatggccacatctcagatccacatgtattgcaggatctgagagatgctcagaatcctcatcactgaacaatcagatgggaccgcacagtgagaagacctctgctttaatggttatgggccatgcattgaaggaccaccctgtctgtgctaatccctcactttgcactgaacatggaactaagctgagcctctccctggggatgagatgatagattttctatttactgccctttcttttgtcttttcatagcttttggtgcggacatgtcttggagcagttacagtcaattgtctctatgctcaatttgcttgtttattccatgaatactgagcgcccattatgttccagccactggactgtgcatgaaggatacagcagtgagtttcacaaagactccttcctcaattaggtcttctagataagaggaggcagagacatgctagggtgtgtggttgggctctgtaggcctggcactgctccacacaaagatcacggctcctagcaggtgcttcgcacatatgcttccctctgctcttaacacaactgacatctttccttttggtgtcagctaaatgtcacctcctcagagaggccttccttggccaccctatgtgaactagaccccacccaccaagtacaaaccctccataagttttgaagcaagttctctggttctattacactttatcatgctgcctggtcaatgaataaatagtaaaggaaatgacttatggtgaaatccctatctgccaattaaaaaaaaagatgtccattttggaagggtttatattctaagaaagaagtcccttttcaaatgctaaggaaggattggttgggaataattgccattagtaaggaagccctggttctgaatatgaatattatgcttgattaggctctgggattcatcatggaaactatctggcagctgaatcaaagtgcagtaaagagcagctgtagtggagtggatctggatttgaacggctagctgtaagatctgagatctggggcaagttgcttaacttttctaagactcaatttcctcttccttaaaatgcagataacagtatctacatcgtattttgtttttggatgcagaataaaagagatgatgcttgtcaaccacctaccccacagtgcatggggcattgtgaacacgtgacaaatagtatctttccttatggagcacatataatcatccaaaactcactgatgtccctgatgaagaagctgctggtgtagttttcatacttgagcttgtgaacggcatccaccatgacctcaatgggcagactctcctcagcagctgggcaggcactgtcctcctggcactccactgagtactcatactccttgttgtcccctctgactctctctgcagagagtgtagcagctccgcacgtcaccccttgggggtcagaagagctgaagtcaaagacagaaattagcctgtgttacacattggggagagagttcctagtgattgtagccagtaaggcaggtaaggcctcaactgttgtctgaggacacagtttctccaactgggctgatttctacccagagggtaagaaactgccctccccaggagaaaaagcttaaattcaagagcacttacatgtctctggactaaatgaatatggaagtttttgtttgttttagatctagaatctctgattattaaacccccttgttaaaaacttaaattcattttttcccattttaattataaaatcaatacacaaatcagtacacactaattataaaagtaaagatgataaagatccatataaaggaaagaagtgtatgtctccttcatccttaactgctctccacaggtttaagtactaataatagcttgttgtatccttccagaccttcctttttctttttctttctctctctctctctctttttttttttaagagacagggttttgctctgccacccaggctggagtgaagtggtggaatcagaccccactgtagcctcaaactcctaggctcaagtgatcccctccctctgcctcccaagtagctgggactacaggtgtgtgccaccacacccacctaatttttttatttttaatattttctgagatggggtctcactgtgttgcctaggctggtcttgaactcctggcctcaagcaatcattctgtctcagcctcccaaagagttaggatttcaggtgtgagccactgtgcctggccagaactttttcaatgaatattcaagataattgtatacacattttatatatatatatatatatacacacacacacacacacacatatgtatacacacattatatatataatccatgttatatacatctctacattatatatatccactatatatattttacttatacatatagattttatttttatgaactaggatcaaattgtatacatatgattatgtaaccatccttttcccctctgaacatattatggggagctctccatgacaaaacatatgggttgggttatccacttcaatgactgcacattaagcaagagtatagtgtaccatgttttatttaaccattcctctgctgattatgtctttatgcacttggagaaacatttctttagtaagcattttccttttaaagatgaaaaagtgagaccccaatgcttaatttactcagtgaaataatggtaaagtcaggatgatcacctggggtttgcttcggtgatgattaaagtaagccacatgggggttaacacataggtcttgtatttatggaagttgctttcttacggaaagtccaggtgcattggaccaacagcgaacttcagattagtggtgtcagcagaagtaaaaggagttgaggtggccctgggaaaatttcgggaggcctcatcgagttttggagtctgcttcagggcccctaagatctacgccctggagctcttgtttttatttttgactcaaggtgcaatttcagcaagtcatttgtagctttgaattctccgtttatccctttctttggtgctatgaggcttcaggaagcatggccaggcaatttggatgagtgggttcaaacacagcagagactattctcagttcccaataatatcctgccccaacacatacatttattcaagcaatcggctaaaatctccatgttctttcttcaatgtagacaaggaagggcggttgaaaaaacacgggtttgactttgcttttcccattatcattaactgataggtcactgagaggttgcccttaatttcttaatgaaatagttctagaaaaatgctgagaaaccagagcagtttcactcaccctctgctgcttttgacactgaatgtcaaatcagtactgattgtcgtcagccaccagcaggtgaaacgtccagaataattcttggcctcgcatcttagaaaggtcttatttttgggttctggatttgaaaaaaacaaaaattcaatatttaggagttttttgcagaaaggttttgattgtgatgaatcacagatcaccagatggtacagggtgaagttcttccatgcgttgcctcttgggtagctccataaggattgggagtatcccagtggggtgttgattctgcagagtacactacacacctaacatgcctggcagaggcattcattttttgaaggctatcaccccagtgcagagtgatacactatcggttaatttccattagccattaaataatatcaccattatttaaagaaaacatgaggctaagcattcagactgatcatgaaactcccttaatatgagattttgatggttgataacccaaagggtccaggaaagcaaaggaaaatggaggttaacatcaattaacatcaataagagacttgatgttaattcattacactcaccatgacttggcttttcaatttgttgttgttgttgtttttaactcttatgagcgaaagagaaaattgatactatccaagggtatagaattacctttctggtcctttaaaatatcagtggaccaaattccatcttcctttttgtgaagcagcaggagcgaatggcttagaacctcgcctcctttgtgacaggtgtactggccagcatctccaaactctttgacttggatggtcagggttttgccagagcctaagacctcactgctctggtccaaggtccaggtgataccatcttcttcaggggtgtcacaggtgaggaccaccatttctccaggggcatccggataccaatccaattctacgacataaactggaatgcacataaagtggagaaccaggctgtaagctccaggaactctgggactgtgttttattaacccttcgggcatccccattgcctaaacacaaccttgtttacaacaagtatttggcaaatgcttgctgagatgatctcaaggcatgagaccctgcttgggctcaaggtcatggaaaagagaaacaaagagttttatagctgccatcgactcattgactggaaggctgcctttaatagtaacctttgattatttagcagattggaaacaccttaatataccaaaaactgcaaacagcacaagactctttgccaaaggtctgggggagagaaacttccagcacaatttcagtttcatagagaatacggcagggcacaatattcagcagagtaacatagtggttaaaagctcagggtgtcgagaacaacgaaccaagactgtcatcctgtctccactaaccagctgggggatttggaacaaggtatttcattatcatgagcctcagtttcctcatctgtaaaatgataataataacagtatctgccttacatttgactgaggattaaatgaaaaaaaaaaaaagcacgtaaagtacttagcacagtgtctgccacacagtaaattcggtgttagttatcgttacttatagactgaggagtcagccaactgtacagagaaactctcttaacaattttccatggatatttaaggatttcgttccctctgttttaaatcaccagtggagattttcattctctctgcattattattattattattattatttttagctatcttacactcttatgaagcagtccagtagagcttagtcttcccatttaatgaagaagcgtactgaggccaacgatctaagcatggtcacagcaagtcagaagtacaagggctacagctcagaccttttgtctcttgggctttgcaagggatgcctaatgctagtgtctaaactggcctttgaggaatggcttagtatagtatttcagagtgtgtcatagcaaagcttcattcatttttttaatccatgcataaattattaattgaatagaattgtttaatgtagtagttcccaaagcatgatcgatgaaacaccatcagcagcatcaccttggaatagatcagaaatgcaaattctcagctgctgaatcagaaaccttgggatggatttagttatatggttcttaagctctccagatggtgctgatgcctgctcaagtttatgagtcacagtggttgagagcctgcattttggagtggcagaggcctggatttagaagcagctctagcccttgctccagtcttgtggcctttggcaagacattcaactactgtaagcctcagtgtcatcatctttaaaatgagaaaaatattagcccttgctttagaaggtggatatgtggattatataagctcatacacagtgcccttacatgctttataaatggtggttctcgttattggcctctggatgtaaagcattgtagaatataaagttttcactttacatcaattggattataaggactgaatggataacaaaaataagaggtcaaaagcatttggggtccaactctggggaaatgattagctgtgctgatgtaaaaccatgtggcacttttggctttttcttggttttttttttgtccccctgacacctgaagagcatggttactttcctgtcccaactgaggctcggaagccctagaagatgtttgctcaacagcagggaaaacagctgcaggaggaaagctgaagaggagcatcaagaacctggcacttagcctcactgcatcgtctgccctcctaagtcacacctcggagagtttctcacactgattttctggaatttctgtggtttaccaaatcagaagtcactaaggggtcaaatatgccaggaccaaggttcctgagctcgctaacaatcccagggttggaagggatctgccatatacccctggctcaggcctttgcctttacttaagagagtgtctaaatctctcaaattctcatggagaaggggtggctggattctgtcttcctaaaattcttgagaagagaggagtggtcccagatttctttcaggtacccatttcaagatggtactttctagaatatcaaaagattatttctgatcatcagctgaaatattttcatccttaatttatgtccatttcctcttattcagctctccaaagacctgggaaaaaattacttcatgtccttgtaaaaacgttttcacaaatttaagtgcaccagctttgaagcaagacagaattgggatcaagtccctgttccacccttaccaggtatgtgacattgggcaagttacttaatctctctggcctcagtttccaacatctgtaaaatgggatacagacagtctctacttcatatggctcttgtgagaattaagtgagacagtgcactcaataaacattaactattattattatacaattaaagatagtaatcgccaacattatgatgttggcttcagtgataaaaatctgagggtctttcaggtacagccaacggtcagaatgcacatttactgagtgtgagatactagaaggatgggcagaactccttattttaccattaactattctattagtctactaataatttttactgatcattgggataataaaaagtatctcttgaatcatgaaagatattttaaacaaccaaaatagtaatactagctgacatttactttcactttactatctgtcgagttgtattctgcattcattaacccactaaataacccacgtggtaggcatccactttgtaacatccagtttacagttgaggaaattcaggattagaggtgacccagcttaaagtcacataaccagtcattgacagacctaggacttgaacccaagtcaatgtgagtctgaatcctatgcttcctccaaagtgcttggtcagaggtaagtcatcacagtgccaactgagggggcagtatcatgtggtggaatgagaaacgaacacagttgttatactttgcaaatcctctactttggaattttaattgtgtgaaacagtttttagtaatattggaaaatatcatatgtcatatgtctttccccaccatatcatatatcatatgtctttccccaccatagtgtaccaatgtcatccaatgtgaaaaccaaacaatatagataccatcaaagtagaaaagagagatatggcattgcattttcccagagtgatggctttctctagaggacccagtgcatggttgcccatttcagtttgatttcccaccagtggctgcccaagagtcctggcttagaagtggggcctccacagagaataatgagaggctggttaccatctttcttcagttcccatatggccacgaggggagatgccagaaaaaccagggaaaaccaagagatgaccaactgctggtgacacatctataagaagggagagaagcagggggaagagaaggaggaaaagagaaggaagaggaagaaaaaagagaagaaagaatgtcaataattcttgttacctttgtgaaccatatacacattctagctactttttttttaaataaaatcttgattctcccctttcttctccatactgtcaagcaaatactaagtaaattacaggagttctatggcagtctgtggggaagaacatctctaaatagagaaccatagggtatttggggctctggagctgaaagagacctaaggcaagccatctgatacaatcctcttatttttaagatgagaaacttaaagcttagagaaggaatgtgactttctggatcaacatctagcagttgtttatttagtgcttactacataaagagcactgggctagaagcagttgagagagaaaaaaagggcttacctggatcccgcttcctaggagcaaatacttttactcaataaatatttattaagtcagtgtgttaaatgcctccccgccagctggggagatgagccatacatttgtatcactgcagcacaaagcagtgtgtgctggagcacccagaactgaaggacttgggttagggacaggaacggtaatacagaggcgaactttcaggttctggcaacgacctggtcaccagcccttgctgtaggggtttagcttctcttgttttccaagttcaaagactactctctcccatatagagaacctagtggttctaaaatttgagtgactgtcaggataacctggaagcactgctacaacagacggctgagtcccacccccagagtgtctgattcagcaggcatgagggcctgagaatatgcatttctagaaagtttccaggggaagcagatgctgctggcgctaagaccacaccttgagaaccactggtttaacccatgttcagggtccagaacccctgaaaatcaaagtgttcattgggaaaagaccacaacatattgatatatccaccatgaaatagtaaaatgcataattttatgttaaataagccaccatctgatatagaaaccagtctaggttagtatccagggtttatgaaaatcttccgattgcaaaaattacatgccacttacgaatgaggtagggatgattattgaaacattctgaaacaactccattcaccttgcagagcacccatggtctggaggaaagtggttctgaaaccactgttttaaactatatgaagggcaatgctcaactgtttcagtcaaataccttaaaaatgagcattcctgggttgggtgacggaatattgacaaattacagctttgtcagaactgctactaactctaggcggaccttgctatgtactttattcccttataaagtttgtgagtggcagagacaggcctagaagtcaagccttcttggacactgctcagtgctgtcaccacagcatggagttttaggggcatggctatcacttcagtctaggttatgactgtagcaaagtactagctggcacagggcaccggttagtacattcacaggcttgaagttaaacagacacaggcttgaattttggtcccaccgctcatttgctgttgagcagtgggagcaacttgttggccaagttactcgctgagcctcagtctctttgtctataaaatggacctaatacttatctcaaaggcttgttgggaaaggcaatgagataacatattatagaaggcaaccaataacatattaacttgaacctagaggaagaggtaagggaacaattcggtatctgtgttttatatatcatggatagtcaagaaagtcattctaggcagtagggaaatgtgcacagaggtactgcaattacatgcgcctgtaaaacccagaggctggcacactggaagggaaatagtggagattcctggcatctcctggccacttacgctgaggtattcccactagctgtgtgcccagcacttcctctgcatgcctcagatgcatttgacaatctcaggtgaactgcacttcagggtcaagggaaccccggccatggttctaagaagcaactcccattttagtatcacctacatttgaaaccacagagcactgtccaggagaggtgatggtggtgggtctcctcctttggctctctggcccatcagctgatactagggagcgctatccctcagcccacatttctcagcatggtaagtctgagagtcttgatgattaaaacacatttttgtgtgtgcaatttcataggttttctaaactcttgaaacccttgcatgaaggacaaagggaccccacgttacacactcctacttcctggagtatgctaagggcttcccaacactggtgccaacatcagcatgccaatgacgcttgggtgggcatctcttttttaagttttgtttgttacctttaattagaaaagggagttattattaaagaataaaaagatatagtcacagatggcatgggtggcacatgcaaagatccctagtttgagggccaggcagacttctagaactgtgtgactctgggtgagtcacttggcccctttaagccccacactcctgatctataaaatgggcatgctactgtggtaaggagttagtgacataattcacgtgaagtgtcatggtgcctagatgaagtcaggacccactatttgctcccctccttccacagcatttactacaatggcaacaatacagtctcttctttactgtttgtcttctctgccacactgagtgaactctcttatgccatggatcatgtctatcttgttttgcactttacccccagagtccagcacagagggattccatgacttattagtagcatgaaggaatgtacggaaatcatacaatttcagattccagtaaactaaactctaagaggttacccacattccatctagtatcttgcaattccttgtttgaaaaagtgggtcatcacctggggtttagtaatccctttgttaaaatgacattgttgttgcacacaattttacctgggcaagtaaaaaaacctttttttcccccttctcacagatttaaaaactctttaggaagcaataatagcttttcattttttaactggggccaaagttagttaatccacaagaatggggatcccagctgtcattttggttgatatcacaactgacgaccaagaccatcacaaatatgggagcaagtctgatttgtaacattattataattatgaatccaattactttaaggaatgcacgaaaggctttttaaaaatttcaatagtaaggcaggcaccactcactttagctctatacaatcctttaactgatgggcattaacatttaggaatatacttttatacatcaatacacaccacttcaaaataagataaaacaaacatttccacaaactatgcatacacacagatcttgctatacagttattattaggtggcttttaaaatggacactgtacatcggtccctagagtactaagttttcactaatgttccagcagatgactcaccagggatgcttccaggaatccaccaactccctcctgccagctgctggggtagcacactaacggtttctacacctggacagctgcaggcccacagggaggggagggaggtaggggcttgggaagtgcttaccttgctctgggcaggacggagagtccaatggccctgaaacagatgttgtttcttctgctgctgttgctggtactggaacttatatactctactcctttctgatggaaacttaaactagaaactgacttgttgcaacattgaaaacaactctcaaaaccttctgggggaatttcaagaagttccttttttgtttgtctctctctgtgtgtgtatcaataacgaggagggaacatagacatcaaaatcccaggtaatgaactaagaggaaatgacttttgggtggggaataaggaaggagatggagatgctaatttctctgggtttacatcatggccaaggtgcttggagacagcactaggcagattccctgggttccacagatcgaggaagaaggaaggccaaggggcggtcagacgggaggctgagttcatgtcgggatggaacaactgtatgcccaagggcttaaaaacaaaatcctggttcttcccaagtcagagaggatgagatgaagggcaaagggtttagtacatctggggcgccttcctccacattagtcctttaatttcagaaacatactatttaccacccatcttggctccatgcacctctccccacattccccgagtgggaacacacgcgtgcacacacacacccatgcacatttcatacagacacagacctggggagatgataaaactgcgtgtaccactaataagactcaaatatgtgcacatcctgtgctcataggtactcgctcataggggcggatgggagcagaaagtgaaataccctcagggaggcatacagacaaccacactcaaggcacccccccttgggcacccagactacatcctcatttcatttgcacacaaatctatggccctaggggctccgtgcagatgcacaggaatagcggaataaagatatctctcgtggtggaatttcaagttgctaagaggtatgcaaaggtgtacaccggtgtggacccccccatcccccgcccagtctgcacgtgaacaggaacatgtacctgcacgtataccaggtacacgcagacagatgcgggccatccccagagccgccgacagaggtcgctgcgagacggtacccgcgccccacagtccacccgctcctcggagtccccccgcgccccggagtccacccgcgccccggagtccacccgcgcaggtccacttctccatccctgctctcgacctccgcccctgcggtgggggaagttcctggggcggtggctgggaccaggccgggttttaggcgggcgcagatttccgggctaactttcctcgccgtctcagcgcgggaagggggaaatgggaaacccgggccagagcagcggagcttcccagccgcacacttcctccctccagccgtttgtctcggcaggggagggcccaggcagccaagccggcaggcccactggttatccgaccttgtgctctggccgtgggtggagaccttacatccagctcagagcgcctcctcccatcccctgtgtcctctaggcctccccagactttgccttttagccttccagtgaaacaagttctgtatccaagatatacaattaagtggacaaagcagattgcaggtatgttttttcgtatgataccatttgtggggtgtgtgtgcgtatgtgtgtaagtgcacctgcacttttcacaactggtatctctgaggcatatgtaacaactgggggaggggctttttgtaaacatgtattaatttcctccgatccatcactaaagtgtactgaacagaaattgacgtgaagtagtttcactaatttatttacagtggctgcaccaccacagatgagtccttgtgcccccccataaataaatacatgcataaaataagacaagtaaggttcaaaatgacacaaatattttattcatgtgttcgtaaaagcaccttgaaaattaaaaaaaaaaaactgtaacgtaaagtctcagtaaaaatccagcgccagttatgcaaaagaagcttcgaagtatgccctcatcctcccttttccgctcagattgcagcccgagggctagtcctatatgaaagggcccccagtgttcacctccaccagggacaagtaatagggttttaagagcatgggctctggagttagagagctggatacccgcacctgcaagttacttaccttcgttaagcctcagttcctcacatctgtaaaatcgggttaataatagtacctgatctcaggactggtgtgaagattaatgagatatgatgggatgcagttaaagcagcatcctggctaaacgtttaatgaatggctgcttgcacttatttatttttttatcctgtcgtgtcccagaaagtcttttcgtagctcacaaggggacatcaaagatgacaaagaggagtggaagaagacagagagaatcaatgtgaggagcctggaacagggctctgaattgtcttcccacagtgaaatcacttgtctattgctgagccaagaatttgactctgagcatctaggatgagaaagaagaactggcacctacgccatctctgcccctcgggactgactattttggtaagttcagttcacccatggaggaagtggttctcgtactttatctgcatgtaacaacaaaattcaggttcttggggctgatgcttggagattgtgattcagatctgggatggggctcaggaacctgcattttaacaatggaggttctaatgtggtcattggcaggttgttctaatgtgggggccacattagagcctctctcggagacaggctgtacatggccagccagcattctggtaatatgagccaaatgcccattgacctaattttggagaagaggtttatcaacatgtcccacttcacaatccagaccctgatcccaggcaaaataaactgatacctataagctttctattgcttaccctatgggcgaggaaggtctgctgacaaacagagggcgtgctgagctgcaaggttaatgtgtctgatgattaagctgtgacatggaggcaaccccctaaaaaccaaaaataacttaaagaatttttttggccacaaaaacttattttctcctagaagaatgctttgatcatctagtacacatttcaaataaaggagaagccatgtgtacttataaaaattaaaatcttagaaaattacataagcaatacatgcatgcatgctattgtaaaaacttcaaacaatacaaatatacatagaatacaatgttgaggccctgattcctgtggcttccagaggttaccagtgccagcattcctgcagagcttctgaatgcttctctatgtatttatatctatctggctatataaatggaatcatactatacatattgttctgcaagttgctcttttcttgcaacagtctattttgtattcagtcacttgcagtgacttgctagaggtcacttgaacagatttcacgtctgcatcaattaggttgccctgggcttagttttctaaggagctctgcagttccaggcatcaatccactaaggactgataacacctgggataagaaaagactatcttgtcctgttgatgtctcttaggagcaaataatttgccctacaagctccatagccttttcatgaagtctcacttatcacctgtataccactccctgacaaggagaatgggcttattacaaggaaagtgatagacaaggcaggtttgccctactagatggaaagtggtaggccattgagagtcatgaaaccaccctcacagggttgacaagaattgcatgctgggttctggacaggaatatagttataattaagcattgattaggttgcacgttggcccacttccttgttgctcaaagtcacgtagcactagatcctgaccatttgcatctgcattattcctgtagataggatttctgacattagggtcataagattgtgtaggaattgatttgtatccctattgttcctttagatgggatctctgacattacaatcagaacgcttttgtttaagaatcacttaagttgtttttcaggtccccaattctaccatatttcagtttgaaaacccccacaaagaaaggggatcaggttgaaaatacagcttcaccctgtcccatgacttcaccatgcactcttcaaccagtcaaccatctccaacacatcagcccactcccaaactcttaaaaaccctagccccaaatgccacaaggagatagatttaaggtttcttcctgtctcctcatttggtgaccctacgattaaacctctttctctgctgcaacctggcctctcggcgtattgacttgctgtgtgcaatgggcaatgaacctattatggatacagtcacatgtgtctgttacatgagtccaagtgatttgtgcggccagtgaagtgcagaaatagggcaattgtgtggataatgaaaactaaggcttcttcccccaaatggtcagttgcttttgaagggatacttctagcctaggagtatgggaagtagcttctacctcctgcctcatacatacatgctcttaccaaaagaagagtggaagtgtcacggcagatagctagtcagacatgagcagggcagaagagggttcccccgccactccccgcccaccaccactaggaatgtcaggcaaccatcaggtgagggtcagatggttattaaactgtttctctaaaataataattggtcacagctggtaccagggaaaggcagtctcccaatagatagaacacctgaagctggtgattagcagcttccggataagatcttaggagctgggcgaatgggcttaagcatgagcactaggagggaaaatggtcgaatttaactggtgtatgagcttcttctaagaacactcaactagtaagggaagaatgcctcaagtgaacatgcgtacaatttcagtaaacatactgtgtatgtggcccctcccaagtgctggcaggccaccccaagagaagaatcaggggagaagggaggcaaccccccagaagcatgccagcatatgcaaccccaaatcaaaggttaaaccatacacttgaatctctcaagtcaccctccctcttccaagtgtacttccttttgttcctgctctaaaactttctctttttttttaactttttttttgagatggaatcgtgctctgtctcccaggctggagtgcagtggcgcaatctcggctcactgcaacctccacctcctgggttcaagccattctcgtgcctcagcctcctgagtagctgagattacagctaccacgcccggctaatttttgtatttttagtagagatggggtctcaccaggttggccaggatgttctcgaactcctgacctcaagtgattcacccgcctcggcctcccaaagtgctgggattacaggcatgagccactgtgtctggcctcctgctctaaaactttttaaataaactttccctcctgctctaaaacttgcctgggtctctcactctgtcttaagccctttggtcaaattctttcttctgagtaatagggacaggagacagagaaattctaggcagaaaagagtgggggtttttggcaaagacccaccctcaagcctggtgctgtggcccaaagtgagaacatgtagtcctgttttcccactccaatgttgccgtttcccaaaccacccatggcccaccctgcccccacattctgcacccataaaaaccccaggctccactggcagagagcagagaaggggaggagagaagaagcagctgaatgctggagagaagcagtttgacttcagagggatgacttgacagcaggacttcaggggaagaataccttcccggtccctcccctttccacctccccttcctgtggagagccacttccactggcaataaaatcctccacattcaccgcccttcaattcgttcatgcaacctgatttttcctggacaccaaacgagatctcaggtgccatgggtgaggatgctaaaggctgtcacactgaccctctgcccttgcaaaaaggcagagggttcactgagttgttaaacacttaatccaaccatggatagcaaagctaaaaaagtgcactgtaacatatgtcctgtggggctgcaggggtcatgggtactccaccctagatgctgctgtggggcctgcacagagttttggtcctgccggtgcccaaaagcatttgctctggctcttgcacctgctcacctgtgtgctgcccccccgcccatgaggggttgagagctgtggactgagtaagtgaggcattcctgtcaggaggactctgaaggggtcaaggaaaacctcatgtttcatgaggaggcaagaactgaggttagttcaccaccactaacatactttggtgccacgtgattttggtgccacgtgacttagatacattccctagtggtaacagaaggttctagagcacaaaatttaacagtgtatatatgagtggtatgagggcgaattatttttgttttctttttaatgatctcttaaattttccagaatgtctacaatgaccttgtattacttttctaatcagaaaaaaagaaaaaagttaccgaagaagagataagtgaagcacacacaaaaggcagaatatatagtgcatcaagaatgtgtgttttataatctgacagacctagttagaccatagtccatatttcaaatataattacatgtgctcatagctgagaaccttctcctgggatggatgcatttcaccaggtcactgctgaaatgttgtacttttatggatggtgatgaggaagcatctgttttaggtgtggtatttcctggaggcagaaaactgcttgagttagctcattcagtttttcagtggcctttctaatgcatgttttgttttgttttaatgctttgcaaaagattcctagagtggaaattgcctttgcaaaaattataacagtgagaaaattatgacagtgaaagggatctgccctaactgtccccatcttgcttctgggtatctttgctcattcctgggtgtgggccaagctaactttgggagaaatttagttaaattataatggcccttcccagatactaaattgcccttgtaaaactaatgaaaggccaccaagttaggaggatgagaggggcctgaattctgttaggaagtatgcctagccagccattacttaggaggaataaagatttgcaacttccccaattactccagcagataacatcactattttagaatctaagactggcctttggagatgtcttttcaggtttttgcatttctgacaaccggatgggccccacccaggaactgactcaacacaagaagacagtttccactccctatgatttcatctccaacccaaccaaccagcattccttactccctggctccctactcaccaagctatctttgaaaaaccactaacctctgagccttcagtgagactgatttgagtgataataaaactccagcctcctgtacagccagctctgcatgaattaaactttttctctgttgcaactcccctgtctggataattcagctctgtctgagcagtggttcaaggagaacccgctgggtggttagaatcagcttcactttcaaagggcctacaatgtcctcattaatttcttccccttcaaagatgactgtgatcacatgttttcaatatcgtccttccacccttggcccatgataagggcagagggtggtagatgcagtcactactgaatttcattatcccagtgggcatttttggcctgctcaactggactgactgcagagcaagtgttccaccttgaccttgattttgccatttgcatatggaaaccttttttttttttttcctttctaaattcaactctttggtaatcccagtgaaagaaatgggtgtgtgggcaactggaaggaagtgggtgtgtcctaggttgtaggattgctgagatgtagaaatgcttatgctagaaaggtatgagaacagttggtctggtcttgctgttagtagagacagatagaacaagacaaggtgggaacaacatggagtgggcagatgtttgtggtgaagtcctggcatctattgtctgagggtcccctatcaacatcacctccaaccaacaattattgaatattaaccagcatcccctgcatttataggatgaattgttaaagcaccatccaataaagtacattactgctgctactcaccctagagcacatagaattctcctggagagaaatagattgaccaaaaatcggggcctgcaatttggagcatcttcctttgtgacagttgatttgggactcacatttaaggcgcatttgtttctccattcacagaaaatttatattaatattcatcaggcttttattgtatcttgttctggaaatctgctctggaaaataactatgacccctggtcttctgccctgtcattttctctctaatttttggctttgaaaatttatctgtctatctgtctatctatctatctatctatctatctatctatctatctatctatctatctttattcttgatggtactttaaaaaagtaactcatgcctctagtttaaaataaactatgctgggcatggtggctcacacctgtaatcccagagctttgggaggctgaggagggaggattgtttgaggccaggagtttgagatcagcctgggcaacatggcgaaagtccacctctacaaaaaaatttaaaaaattagccaggtgtggtggcacatgcctgtggtcccagctgcttaggaggctgaggcaggagtatcacttgagcccagatggctgaggttacagtgagctgtgattggaccattgcactccagcctgggtcacagagagagactctgtctcaaaaaaaaaaaaaaaaaaaaaaaaaaagtcaaatagtacaaaggttactaagtgtgtctatcttcttgaggtgcctccctggtcccccagtgtgaaagctgtgtataccacagatccaaatcaagctgtcccaaatacccttcagacttggtgatgatcttctagtcattttacttgaacatggaacagccaaatagacagaaacccaatttcatttatgtgttttagtaggtgagagatgttccttttagacctggggagacagaaagaatcttaagaccttggcactgtcaccagccagttacactccagttaaggagacttgacgaagcatgaaagttaaatagtgccaaagacaaaaatatggcaaggtggggttgattagtcaccaaaggaatttacatcaaaggcattaccatgtttgttatgtaggtgccaataataatgaaatgccactctacggtatttgggaggccagaaaatttaacaaaaaggaaagtggcatcctcagtcttattggaggcagcaaagcaaacagacactggagatgaatggtcttgggtttgggtcccagctctgttctactagctgaatgatcttgggcaaagtacctcaattctctgagcctcattttccttataagatgggactactgataatatctacctcagagaactgatagaaggattaagttacatttggcatagaagatggatcaatatatggtaactcttattaaaattaaataatataaaaaagaatgtgtttggttgccaagggagtctagtcttccaatgtagcaataataagtgtataacacagcaaaatttcatctttattagattgcttgtttaagtagattttttttttttgagacggagtctctctgtgtagcccaggctggagtgcagtggctcgatcttggctcactgcaagctccgcctcccgggttcacaccattctcctgcctcagcctcccaagtagctgggactacaggtgcccgccatcacgcccggctaatttttttgtatttttaatagagacggggtttcaccatgttagccaggatggtctcgatctcctgaccttatgatccgcccgcctcggcctcccaaagtgctgggattacaggcgtgagccaccgtgcccggcctaaatagctatttttaatatgatagaatatgt

SEQ ID NO: 14 - DNA, 113494 bp, Homo sapiens
tgtatttcctgcaaagatgccttgcccagtgaggaggaatctagagaagcaccctggccacagtcgctttgctgcaccttggtgaattccgtctagtccaaacctcccagtctccttagggctgttaggggaaaaccgctttctaaagccacagtaatggcagctgcccctccatgaaccaaactgatcatcccaaagcagactccagactgttgtaatggcagtgagaatttaaagccagtggtttttagcttgctgggctccatggaagtgggacctgctgagcgagaccacttggctccctggcttcagccccctttccagggcagtggatggttctcctgtctcactggcattccacacactgctggagtatgaacaaactcctgcagctcagttcctgctcaaacagccgccaagttttgtgcctgaaacccagggccctgatagtgtaggctcaggagggaatctcctgatctgtggattgcaaaaaatccgtgggaaaagtgtagtaccccgggtaggtagcacagtcccttaccgcttcacttggctggaggagggacgtccctctgctccatgcacttcccagttgaagcgacgccccaccctgcttctgctctctctccatgggtcgcacccactgcataaccagtcccaatgagatgaactgggtacctcagttgcaaatgcagaaatcacccgccttctgcattggtcttgctaggagctgcagaccagagctgtttttatttggccatcttggcccctccccgtatttcaaatttaacatgttccaaaacaaattattcatttccttccccattcctctacaaaatatattccttttaaagttttacccatctcagttaatggccactttacccaacctttctagttacttttgccagaatctgtagaataaaattgttttcacttcttggcttaatacccttcaacagcttcccatctcaaccatcaaaagagcttccctacacaactgtccactactcttcactgcagttacgtctctgacccccatttccttttattcatctgctactgttctcctcttgctcttcccacaccggcctccatactgatccttgaactctttttcttactcttcgccatctcctgtctgtctgaaatgctcttgtccaaattaactccatggcctgcttcctcgcttctattagatctttgctcaaatattgtatttcagagtgatcttctccgagcatattaaacttgctgtctacctttcccacttaattttctccaagtgcttatcaccatctaatattgtattttactttctgtctctcttctcagactagaatgaaaactccatggggaccaaacttttgtctgttttgtttacccctttatcctcagtgctagaataattattggaacatattacacactcaagaaatattttctgagtctgggcacagtggctcatgactgtaatcccagcactttgggtggccaaggtgggtggatcaccagagggcaggagttggagaccagcctggccaacatggtgaaaccccatctctactaaaaatacaaaaattagctgggcatgatggtgggggcctgtaatcccagctacctgggaggctgaggaaggagaatagcttgaacccaggaagctgagtttgcagtgagccgagactgtgccactgcactccatcctgggcaacagagcaagactccatgtcaaaaaaaaaaaaagaaatattttttgaatgaatgaatgttgtaaaagtaatgtaggacaggtgagcccccaaactggggtttagcccaggagggttcttggtttcacccaggaaagaattcaagggtgagctggaggtgttcactagaaacttgtaatgaagtagaattggacagcagcagcagagatactgctcttgtggagaagggctattccataggcaatgtgcccagaggtagttttgaacttatatttataccaattttaatcatatacaaattaaggggcagattatgcagaaatttttaggaaaagcgtggcaactcacaggttgttgccatgaaaaggggtggtaacttccaggtgttgccatggtaatggtaaactgacatggcatgctggtgggcgtgtcttatggaaagctactttgctttggacctgttttagctagtcctcagtttggtctggtgtccaagtcctgcctctggagtgaagtaccatctcttacctcaaaagtagataagtattgataaggtttggatttgtgtgccagcctaaatctcatgtgaaattggaggaggggcctggtgggagatgattggatcatgggggcagattttacccttggtgttctcctgatagtgagactatcactatcagtgattgatagtgagactatcactatcagtgattgatagtgagactatcactatcagtgattgatagtgagactatcactatcagtgattgatagtgagactatcactatcatcagtgattgatagtgagactatcactatcatcagtgattgatagtgagactatcactatcagtgattgatagtgagactatcactatcagtgattgatagtgagactatcactatcagtgattgatagtgagactatcactatcagtgattgatagtgagactatcactatcagtgattgatagtgagactatcactatcagtgattgatagtgagactatcactatcagtgattgatagtgagactatcactatcagtgattgatagtgagactatcactatcagtgataatgagtgagttctcagaagatctaattgtttaaaagtgtgtggcactttcccctgctcgctctctctcctgccaccatgtgaaaaaggtgtttgcttccccttcgtcttccatcatgattgtaagttttctgaggcctcctagtcatgcttcttgtgagtcagaactgtgagtcaattaaacctctgcaattaaacctgcagaactgtgagtcaattaagcctcttttcttcataaattactcagtctcaggtagttctttataacagtgtgagaacaaactaatacaagtatataagtcaggacaaagatggatggaccaaaatgataaataataattctcatgcagtggtgcatgcttgtggtccctacttgggaggctgaggctggaggatcccttgaggccaggagtttgaggctgtagcatgctatgatagtgtctgtgatagatgctacataaacattcttatttaatagccatatgcttattttaatgtgtatcaggaaaaataaaacagcatatcacaaatgtgattttctggatatgacttattaggatgaggctaaagcaggtagagctgtagtaatctgtacgacgcattaattacagaagaagactcagacctgcccatgattgttatacacctgcagggactgaattttctcctgtaactgttcataagaatgtataacttggatgatgctattcactagtatgtttttaaatttttaatatttatttatttatttttaaaaaatacagatgaggtttcaccatgttgcccaggctggtctcaaattcctggactcaagcaatccacccaccttgacctccaaaagtgttgggattacaggcatgagccaccgcgcccagcctggtacgttctcatgaactgaattttcaagctcattcctgcattattttcagcactaaattgaaatatgactttgagaagctgacaattgttgagtactgaagtattaaaatgattgcttgaaaacacaatctagtcactgttgtatacaccagcaaaaaacaaaaacagaaaatacctgagaatgcacttgaagtttggagagaagtgtttaaatggtacttttcaaattgccaattgaattgtaaaaaccactgaagaccattggcttctatgcagatgggtcctcactctttcatttgaatagatggcaccctaaatctttctggagaaaatcctcatgttttagaattgtttgtatgaatagatttgcaaaccagactatcttattgatatctttgttaatttggacaacttacaatcactattagaatgcacacttacattatatgtgaaggccaagtgaatgagaagatctgcaaaacagaatgatgggtgtgcaccttgatcatgtgaactctattcttttttgttccccttttttttaagagacaaggtcttgctctgtcacctaggctggagtgcagtggcatgatcatagctcactgcagcctttatctcttgggttcaagcaatactcctgcctcagcctcctgagaagcagctaagactacaggtatgtgccaccatgcccagctagcagagctctattctttatctgaaaaattctctaaaagtatttaggacattatgaaagacttcataagattttttcttattgattggcaagagtgaatcaataaaaccttatttaccttatcatcagctattgtttatagcaattgataccaattttccatccaaacaataatactaataagtaataataatgtgtcactgttaacaataactattatcattgcatttctgaaatggccttttttacttacagtcactgaggctctaggtcaattttgaagcagacagaacaagcgggaaggggaagttaatgggataaaatctttctctccccttccactcatagttgaatttgcctaagtgaaatcgtacatcagtaggccagtcagtaattccctgcagctatctcatattctagaattgactaggaagaatcctctatttacgttcctttccttgaagtttttcttgtctttaatgtgttcagtattttataaattatttacaaattatcacatataatatactcctcctaaaaataggaagttatagaaaagcaaaaggaagaaaaaaatcataattccataatccaaagaaaactactattgatagcttgttgtatttttttctacatatagtttttgtttggcttataaagttgagcttcaatgcagtggtctttcaaatgttttccttgagtcttcttaaaagaagattttcaaactacgtactcccttgcatattttagaattaaaatactatatatatatatatttgtttttgtttttgtttttttgagatggagtctcactctgtcgccaggctggagtgctgtggcgcgatctcggctcactgcaaactccgactccctggttcaagcgattcgtttgcctcagcctcctaagtagctgggattacagacatgagccaacacgcctggctaatttttgtatttttagtagagatggagtttcaccatgttggccaggatggtctcgatttcctgaccttgcgatccacctgcctcggccaacaaaagtgctgggattacaggcgtgagccaccattccaggcccaaaatatttttaaagctctaaataaacttactttcttttaaatataatagagtgattgaacatttcaaagacgaaaaaactaagacgaggctgttaaagacacagatatgccatgatatgatttgataaaatagccttttactatcttattgaataaagttaaccaaatctgaaagaaatcaagtaaaattttacatataaattttatccaatgtttaaaaaaaaaaaagtaatggttcatcaaaaatcccatttatggcctggcacgatggctcactcctgtaatcccagcactttgggaggccgaggcagacggatcacgaagtcaggagattgagaccatcctggctaacacggtgaaacccatctctactaaaaatataaaaaattagctgggcatggtggcacatgtggcaccatggtggcacatgtagcctgtagtcccagctactcaggaggctgaggcaggagaattgcttgaacctgggaggtggagtttgcagtgagccgagatcgcgccactgcactccagcctgggagacagagaaagaaaaaaaaatcccatttatgttcaagaggatagccataagtctcccatattccttcgatatcctagattcagagatccaaaatgggctcaaatatccctgaattggctaaaattctgagtatcccagcatgggctgaaatagaaatattttagtgagcttcacatatatctatatgacaggaaaaggcttaaagtcttggatgtttaaaataccttgattaattatccaaggagccctccctaaaaccagtatttccatttatccatttgtttgatattctggagctatttacacccaaggcaatgcactacatgagatttgagatggagggatgctattcactatgaatttagagaatgattactgtgaaccccggctcattttcaaggaaatcagatttaggaaagagcacatatggaatttgagaatctgaaaactgacctccttaaaggtgtgcacgcagtcttcaagagctagagttgtatgttgaaggttttgaatttaccttcacttactggcgttgtaaagtctctaagaagctcttaggaaataagtcaacattggcttttaatgcacacctcacaggaaatggtgatgattcaatcttttttctccaacaaagctgaatgagccatgaggtgctggacactgagaagaaaagagcagctgctacagataccatcatttggatgagtcaaaagatgtatgtggccaggtgtggtgactcatgcctgtaatcccagcactttgggaggccaaagtgagcagatcacttgagattaggagtttgagaccagcctggccaacatgatgaaacaccatctctacaaaatatacaaaaattagccaggcgtgttggcaggtgtgtgtagtcccagctacttgggaggctgagtcaggaagatcacttgaacccaggaggcagaggttgcagtgaccagagatcatgccactgcactccagcctgggccacagagcaagaccctgtctcaaaaaaaaaaaaaaaaaaaaaaaaaaaaaagacagaaaagaaaagaaaaaagaaaagaaatgtaatccccagtgctggaggttaggcctagtgggaggtgtttggatcatgtgggcggatcctgcatgaatggcttagtgccatcctcttgatgatgagagcgagttctcgttcagagttcaggtgagatctggttgtttaaaagtgtgtggcacctccccctgctcctcttgctcctgctctctccatgtgatgcacctgctcctgctttgccttctgccataattgtaaacttactgaggcctcaccagaagccaggcggatgttggtgccatgcttgcaccggctatagaactgtgagccaattaagcctcttttctttataaattaccaagtctcagttattcctgtatggtaacacaagaacagtctaatacactcctagaataaaacatagggaaaaacctctttgacactggtctgggtaaaaatatttttagatatgacactgaaaaaacaagcaacaaaagcaaaaataaataagtgggactatatcaaactaaaaagctcagcaaagaaaacaaccaacaaaataaaaagacaacctacagaagggaaaaaaatatttgcaaatcatttatctgataaaaggttaatatccaaaatacataaggaactcaaatgactcaatagcaaaaacaaaaacaataaaggccagaaaatctgatttaaaaatcagctcttgggcagagcacggtgactcacgcctgtaatcccagcactttgggaggctgagatgggcagatcacttgaggtcaggaattcgagaccagcctggccaacatggtgaaaccctatctctacaacaaatacaaaaaaccagaccgggtgaggcgtctcacgcctgtaatcctagcactttgggaggccaaggcaggaggatcacctgaggtcaggagttcaagactagcctgaccaacatggtgaaaccccgtctctactaaatacaaaaaaaattaccggggcatggtggcacatgtgtaatcccagctacttgggaggctgaggcaggagaatcacttgaacccaggaggcagaggttgcagtgagccgagattgtgccattgcactccagcctgggcaacagagcaaaactctgtcacaaaataaaataaaataaaataaaataaaataaaataaaataaaataaaacaaaaatcagctcttgattttccatagcctcctaactgggctcttcatcttcaatcaattctccacacagtgttggagtcatatgttgcttaatgactgggataccttctaagaaatgtgtcatcaggcgattctggacctgaatagatttttttttcaaggaagacggataaatggccaataagtatatgaagaggtactcaacattactgattatcacataaatacaaatcaaaactacaatgagctgggcgtggtggctcactcctgtaatcccaggactttgggatgccaagactggcagattgcttgagttcaggagttcaagactagcttgggcaacatggtgagaacccatctctaccaaaactacaaaaaattagctgagtgtgatggcatgtgcctgtggtgctagctactcaggaagctgaaatgggaggatcacctgagcccaggaggcagaggttgcagtgagccgtaatcacgccgctgcactccagcctgtgtgacagagcaagactctgtctcaaaacaaaaacaaaaacaacaaccaaaaccaaaaaacaaaactacaattagatatcacttcccaccttttggggtgcctatgataaaaagacaagatataagtattgctgagggtacagagaaagggcagccttgtacactgctgttaggaatgtaaattggtacagttatcatggaaaacagtgtgaaataaaaacaattttatttaaaaaattaaaatagacctaccttaggatccagcaatccctcttctggatctatagtccccccacagaatgaaatcagcaccatgagagatatctgccttcccatgttcatgaagcgttagtcaaaatagcccaaacatggaaataacattttaagtgcctatcagtggaataattggtaaagaatctgtaggctatacaggaatattatgcagccataaaaaggaaggaaattctgccattgcggtaacatagatgcaacttgagggcattatgctaactgaaataagccagacagagaaagacaaatactgcgtgatctcacttatatgcagaatctgaaatagttgaacccataaaaacagatgatagaatggtggttaccaaggttagagggtggtggagggaaaggaagctattggtcgaagggcataaacttgcagttataagatgagtaagttcaggagatctgatatacagtatggtgaccatagttaacaatactgaattatacagcatacttgaaatttgcttgaatgttctctctgcaaaataaagagtaactaaataagatgagagatgtattaactaacttgattgtataataacttcacaaaatatgtatgtatcaaatcatcatgttgtatatcatcaaattgtagaattttattcatcaattatatttcaacaaagctggaaaactaaaaaaagaaacaagtgtataattaataacaatgctggttgtaaattaaaactaagcgtcatatttttggtgtcaaaatgtttgacatttttaagaaaacatgtataagtgttctgcctcttggatgagaccattttaaattaagctgtaaaaaaaaagtaccgacaaaacagttcactttcagtaatctggatttccccaaatagtgacacgagagccagtcatttcgaattggacagtttgagttcctcttcaagagtctgcaatgtaggtcagggctctgctgacatttccattgacctcagaagtgaaaatctaaagtgagtgctgacaggcaggcagtgaggaaagaagacatgacacagccaacaagggtggcagcctggctctgaagtggaattatgtgcttcaaacaggttgaaaggtaaataggcagcgatcatccaaatacttaaagacagctatatttccttttggaaatacatgggccaagttgttttctcttgcaagttctcatgatattccatgcagtggttactgatgaaaagggaatctataatattatatggcatcacattactttaaataataattattgcatatttccatcagttaacttctaactaggaacatttttagggcttctgttgcttcttatgaagagaagaattactattgctaacaaataatgaaagggatccctatatttctgagccaaggggaccccagtttttttaaatgttactagatattttatgcgatatgatgagccatgcattgcgttctcttgtagttttatagaaaaagctcaggttttattaaacagataaaataactgaataatgttgatcattgagtaaatgagttaattcatgtaactgattaatcaaatagtgtaactctagttgtaaactaacaacggtattattaggaatttctataacgtgttcctttcgcgttctctacagatgaaaggctttttcctcttttttagggggtgcgggggacaaggtctcactctgtcgcccaggctggagtgcaatggtgtgatcatggttcactgcaaccttcacctcccgggtagctgggatgaccgtcacatgccaccacactgggctaatttttgtatttttagtagggacagggtttcaccctgttgcccagcctgatctcgaactcctgggctcaagcaatccaccggcctctgcctcccaaagtgctgggattacaggcatgagccaccacgcctccccagatgaaacgctttttagagtctcactggtgagagcacatattgcttaatctcacttcacttttcttaattttgaatccattttctctgggagttctgaaatttttggctcttcccaagtttagctcatcaaagactagtatttctggagtgtgataagtatgtaactttggcagggagaagaattcatcaccagaagttagctcagcccaggcaccatggttcatgcctgtaatcctagcactttgggaggttgagttgggaggaccgcttgagcccaggagtttgaggttacagtgagctatgataatgccgctgcactccagcctgggctacagagcctggcccttgtctctaaaaaaatttaaaacataaaataaaaaaagaagttaactcagaggaggaggtttctgatgagaaaggctagattaggaggcactgtaatggatcaaatgccctactgagttaattcatagtgacttttgaagagtataaaattccatttatttgctttacttctccatctcttgttatatctcctaaatataccagtaacatttctttgctctgtttccttccttcctttcttccttccttctttccttcttcctccctaatcaaaggttcccatcaaatacaataattcttagggaaaaatgttatgctttttattattttactaaaatactacaatttaaacatttttcatattttttttccagagggaaacagtcttttcctgcttccagacatgaatcaggtcactattcaatgggatgcagtaatagccctttacatactcttcagctggtgtcatggaggtatggtgttttatgtatctattgctatctttcattcaacaaatggaatattgagtgattatcattttcatggttttatgttagaatctctgaagaatacaaatattattagactagaaaaaatgtgtgcataaaaattacatagaatgaaataaaaatggcccaatctccttccaaatgcaggatttctttctcaaatttcccttctagacagccctcttactcacatgtggatatttccacaaaggagcttattagtttgagttggcatgttctattgtcaaactattataactgttatataattacctgtcaaacatttggatgcaattctatttcacaaaccacttgttgatagttactttgtgccgggcacatagtaactatgtgggccattggcaagagtatgattttattcattatattcaaactttactgaaaaaagtaggctttatctaaaaaagaacaaaagattggttgagtagctagagaatggggttcagattctacagtgcctagtgttatttctaatcttacctttgaaaaatactgtagctttataatctctcggttctctactttaaagtaggagagctaattatatttgctctttagacacttagagaagcttccaggctgactctagtcttgtgtcatggtgctgaacatcaataaaagcataacagaggccagacgaggtggctaatgcctgtaatcccagcactttgggaggccgaggcgggtggatcacctgaggtcaggagttcaagatcagcctggccaacatggtgaaacgccatattagccgggcgtggtggtgctcacctgtaatcccagctactcaggaggctaaggcaggagaatcgcttgaacctggaaggcggatgttgcagtgagccgagatcgcaacactgcactgcagcctgggtgacagaatgagactgtctcaaaaaaaaaaaaaaaaaaaaaagcctaacagaaacacactgtaataggctagtttatgaaaagatacatctagtcctaaaactgttttcaatggaatcatttagttaatagaaatgataaatttaaaatgcaatagcatattcttctgaatctcttgatttaatgttttacgtgtaatttattatttttccatttatttctaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatgtaagtgttggggcacatttgaaatgcaaacaaaagctagtttaacaattaactggtcattaccacactagtctaaaaatagggacaaaataatatagttcagtttttagattagtttcatacaggagctgcaaactcaaatgtctccagggccaggttggtgaactatatgaactgtagccactgcccagatccagtaatcacaggtgcccggtattcctacatcttttggcttttcaaaggaagacagaaacataaaattttaatgtgtactctctaaattttaaaatgttgccaatacattcaaaaaacaatttttcacctctaccctgaacgaacactgcatatgtgagggccagccccgttagatttaaaatgttgctcttttaatcttcttgtttatttttctaaactaatataatataattaaccttgaagcagatcccattgagaaattttgaggccaaggtttagggagagttgcaaaactagttttgtgctcccactgtactgctaggtttgtgaccttggacaagttgcttaagcctcaattcctcgcctgtaaaaggaggctaattatacaggctgtgttatgcacttaatttcaataatttatttggaagcatatgataaagtttaaagtacatcagtacccaaatccttaaaaatgcatccttttgataaaacatagggagagtctcctacagtcctctgttcctaatctcactattccaatttagaatcactgtgtttgttattgtaactattaatttttttctttttcttaaaacccaccttgaagggaataattattaatttatttaaaagcttagtcaagtcaatcttaaaaatatacgctaaattcaatgtgtgctctgagtgtcctggaggtgtttaaatcactatagtgatatgggctggctcgtataattatatacctagtttgggttctactattatgaagggtgtaaatcaataagttcagcactgttttaactcagatattcattctctatagcacttgaacccattttcagtaaaaaaataaaggaatttgtgtctttgccatgttcccgtcctccacatttttgagaatcaagcctcagttcttgcttcttcttcacctttacaacttagctggggggcagacccatatcaccactaccacctgaccccattgtggctgcttggaaagtaagaggcttccttgctctataatgaggccattgtcctacttaactctgagcagctgatcttgcaagcttttcaagagaaggaactatagaaagttgtagaggtgagttgaggaaggaaagtcataggttttggagtcaaagaataaatctaccttaaactgatgccttaaagctgctaaacttgccctaaattgtggaaattaaaccgcaggcagacatcttatctgatgtaagaaatcttcttagcttgtccacatcctcaggaaacataaccaaacctcaatgcccaaatactttactatttatcctttgggggtgggagttgggtagagagactatacaatttctttggagggcaaataagcaactttcacagttacagaaaaagcttagttgttaatttaagccagaggaaaaaaaaggaagcaaaataaacattgtctctgttaaaaaacaaaatttcagcaaatttagtttttagatctgataggtttttatgtgtgattcatgaatcggcagcatctctttctaaaaaactgatatgtgctctgagtgtcctggaggtgtttaagttactatagtgatatgggctggcttgtataattatatacttagttttggctctactattctaacagaacagttggtttttgtaaggtaggaacaagaaatagaaatttttataaaaactaccagattggttaacattgttacttcaggttattttccttgtaatggttaaagcagaggggatttccttatcatccctgctcaggttgactgggctctttctacgtggttgctgtgaattttctgttttcaggaaaaactagtctgtgggagttttacctgcttccttaaagtttcagcttggttatatgtcacttaacaggagtgacttcattttggtttggtatgtgggggcctagtgcaggagctcagtccaaaacaatggtctcctatacattttatttaacaccaccttccgtgtgttgcagtttgtataactgattactcccaaaagccctcccaagtgttggctggggggcctctgtccccaaacccaacaccaggcaatgtagaaggtaagagaatggactttgttcctcttccaggacagcctaatagaaatacattctctgccgatggctgcttagaaagaacatcactctttccacttatttaacttttgagtttgtgaattgtaactccttacataggcctctggttatgagtgtaaaaatgtaactgccaggtgagaatttactcaaacccctggattcaagctgaatgtcttcttgagctctacattcttagcaaacaaaacttcctatttaagtaggtcaaaaaagggtttttgagggttttgtggcattctagaaatcacattgctttcactggaccactttgatcacaggatatttgtcatgtgagatttattatgtcaacttatcatcactgctttgaacaaaatgattatatgtatttttttagactagagacaaattgtaaaagacaagataaatgagtcattgctttccttgaaaagctatccaaatatattttaaagtgctgtgctttaatgtataatttgtgaaatataaaccatattatcacaatttccatttttagccacaatcctagacacttcttagattcttatctaagactaaatgcacacatattatgggaaatttgttctaatcaggccacaccaatcatgggataaaatacaagatgtctttattcatttaaaaataccaaattaaaccatgcacagtcatgtttccacttaatcatttgtttaaaattttaaatatctttgactttttaaattttaacttttggactttatttacaatgatgaaagcacatttgttattcaataaaagcctctgaatatttgtttctaacattgctattaagtatgattacggaacaattaggctggcctgtgccctgcttgagtaagaaattatagagtgatctttgccagaagcattgcatctctctccattttaatccttcatgttattatcttaatcaagccaatcaattcatggaataaactttattgagtggttactatgcaccaaaaatgtgttaaatgctagaagtacaaagaagaggaaatcacggactgttttcaagaagttctcagtagaaagggatccttggctagactctgaattaacaagaaacctggcctgtgattcctgagtgtcccaataataggggaggggtgggattggcaagaaagagcaaaaacataagcccccttttgtatacctcagagtattctctagtatctagttgtatagccaggttttgttcttggatattgaataacctggcaatgaggcctaacaacaacttgatgttattatcataagcatactcacaggcccatctttacattgcttcatgttaacaaacacttatttgcatgtgtgtgtatagtcatctttttgatcttttgcaaagttaattgaccaccagacatttgtaaccccaagaattcacttcatgtagatgccgtggagtaacacagcccaaacaatctgatagccaaatcaatggcactctgtatctgaaaccagaggaaaaaataacttcagcacaaatcattgtaatcaatgagggaccacaactcaaactccaaaatgatttaaatttatgtttccacacctacttcatttaaggctcaattaaaacaaagatttattttaccctacttggagcccagtttctctccattgtaactcaatgctacaagtcgccaaaatgttgtaaagtactttttagtgtgttcttactgtttgaatataggtttttttaaaaggatattagaccttcgatatatgaaaatagttttttaattataaaatcaaattgcattgaatatagagagtttttaaaatgtagaccagcaaaaaagaaatacctatcattcccataaaaccataactttactagtaaccataatccctctttaataatttggaatatgtctttgaaatttcagaccctctctttctcagtctctcacttaaatgaaaccactaattgaaccattttgcaacctgcttttttcactttgccatatgatcatgacttcactacatatacttttaattccttccaaaggccaagtacttaaactgtcttcttcaacattgcttttggatgtgtttaggactgtattatagtttatttaaccttattttggaaaattaagtttgtttacaattttttcattgttatgaacaataagggaacatcctttaagccaaatattttatatatctatgaacatttcaataaggatgcattcttagatgtataattgctgagttgcaaaatattacacctgcttttacagattgtgatatgtaaagtgctctccataaaggctgtaccaatttgtacttccaccagaagtgtgttagaggatttccatgagtccactccaacactgtgtactatcatttttcaaaatccttgctaatttgataggcttgaatgacatctagtattgccttgatttgcagtgagaataaaatttttaatatatttgtttattgttctacaagcaatatttttggtaagcaatttgcaggtgaagtgaaagcatatatgtacttaagataaatctttggatgtaacttcagacgcataaatgtctgtattttcattctttatgagcccctatccttccatttgtcttgtcattctctgagcagtcaagtgtcccagcagtatttcacacgtagggatgaactaagagagccacacctgaaaagtgaatatttaacaaacactcaatatttctatacttaaaaaaatcttaatcttattcactattgaatgatataactgaaaattctaggtgtcattctatagttgttggggtttcataggctttagaggcccccaaaactcaatgtcatcagaactctctcatcttttccagtctgctaggtattgttttcccctgtgttggcttcattcttaaatagactaaagactgtgaaaaagcctgtttcacaatgacagcaagatggccaccagcaacttacagctcacatgctactcagagatagcagtttcaggaggaaagagtgtgcttcttttacagtggtttagaaaaagtgccttggagaattctgattggttcatcttgagtcatatgttcattcccaaaggcacactcctattagtcggcctacctcagaggcacacttctgtggagagcctcttgattgacaggtcttggggttggggtgggggtgagattggagtgaggggctggaggggatgtcagttctcaagagggaaagacgctagccaatgaaaaataaaaatgtttgccataacatggccacctggagaaagagctgggcaggaatgggggtgggatgagttgagtggagtgacaggaaaagagccttgaaatagagttgcatgaataccaaactttaaaaaaaccttgttgtgttggtggtaaaatacataacataaaatgtaccatttttaccatggttaagtgtgcagttcagtggcactaagtacacttacactgttgtacaaccatcaccaccatttatctccagaaccctcttattgcaaatggaaagtctgcagcctttaaacaaatatccacttccctctcctccaagccccagcaactgccattctactttctacaagtttgactcttccagataccttgtgtaaggggtcatgcaatgtttttcctttagggtctgtcttacttcgcttaatataatgtcttcaagtttcatccacattgtagcatgtgttaaaatttccttcctttttaaggctgagtaatatcttattgcatgtatgaacacccaacttttaaaatgagtagtggaaaatgtgcaagagaagaagatagtctgccagagtagtagaagaaaactacaaagaacccattcgcaagagccaaaggcaaagaggtttcttttcttgtctcgtttttgagacaaggtctcactgtgtcacccaggctggagtgcagtgtcttggtcatagctcactgcagcctcaaactcctaggctccaggaatccttccagcctcagcctcccaagtagctgagactacagatatgagccaccacacccagctttaaaacagagagctttcaaggagggagtgagcaaaatatcaaatgctgctcaatgacatcaaactcaaactcaatgacaaatgaccagagatggggtctgttgaagagaaagtcatcaatgaccttagcaacaatggttttggtggaattgtggaggctgaatcctgattgttttgggtttaaatgcatatgggaaatgaagaataataggctctttaaaagtgtttagctgttaagaaaaaaagaaagatacaggagtagctgggggagactgaatttaggataatatagtcaagtataagaagaagaggaatggatatttgatggtaaagtgggttgcaaggtaaggtagtagggatggaatgaggagcagggaggtgctgagtactgattggcctgacttctcaaataaaattgtcagtttctcaacggactatagagaacttcatatttcttttttttttattcttccattacaaatttattatcttttcagacaagttgagacatactaatttaaaataaattcccttttcagtgaaaagttgataagtttaatcaggtaaagctaatgattaggtaagcaatcaatgtttataattgcatcacaacttttctggccagtgactttttatttatctatttaatttttttaaattatacttgaagttttagggtacatgtgcacaacgtgcaggcttgtttcatacatatacatgtgccatgttggtgtgctgcacccattaactgatcatttaacattaggtatatctcctaatgctatccctcccccctcctcccaccacacaactggccccggtgtgtgatgttccccttcctgtgtccatgtgttctcattgttcagttcccacctatgagtgagaacatgtggtgtgatagtttgctgagaatgatggtttccagcttcatccatgtccctacaaaggacatgaactcatcattttttatggctgcatagtattccatgctatatatgtgccacatttttttaatccactctatcattgttggacatttgggttggttccaagtctttgctattgtgaatagtgccacaataaacatacgtgtgcatgtgtctttacagcagcatgatttataatcctttgggtatatactcagtagtgggatggctcagtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctacctggtgtgagatggtatctcattgtggttttgatttgcatttctctgatggccagtgatgatgagcattttttcatgtgtctgttggctgcataaatgtcttcttttgagaagtgtctgttcatatctgttgcccactttttgatggggttgtttgtttttttcttgtaaatttgtttgagttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgtttttagtgttttcatcatgaagtctttgcccatgcctatgtcctgaatggtattatctaggtattcttctagggtttttatggttttaggtcttatgtttaagtattgaatccatcttgagttaatttttgtataaggtgcaaggaagggatccagtttcagccttatgcatatggctagccagtttcccaacacaatttattaaatagggaatcctttccctattgctcgtttttgtcaggtttgtcaaagatcagatggttgtagatgtgtggtgttatttctgaggtctctgttctgttccattggtctatatatctgttttggtaccagtatcctgctgtttttgttactgtagccttgtagtatagtttgaagtcaggtagcatgatgcctccggctttgtccttttggcttaggattgacttggcgatgcaggcttgtgtttggttccatatgacctttaaactagttttttccaattctgtgaagaaagtcattggtagcttgatggggatggcattgaatctataaattaccttgggcagtatggccattttcacgatattgattcttcctccccatgagcatggaatgttcttccatttgtttgtgtcctcttttatttcattgtacagtggtttgtagttctctttgaagaggtccttcacatcccttgtaagttggattcctaggtattttattctctttgaagcaattgtgaatgggagttcacttttgatttggctctccatttgtctgttattggtgtataagaatgcttgtgatttttgcacattgattttgtatcctgagactttgctaaagttgcctatcagcttaaggagattttgggctgagacgatggggttttctagatatacaatcatgtcatctgcaaacagggacaatttgacttcctcttttcctaattgaataccctttatttccttcacctgcctgattgccctggccagaacttccaacactatgttgaataggagtggtgagagagggcatccccatcttgtgccagttttcaaagggaatgcttccagtttttgcccattcagatgatattggctgtgggtttgtcatagatagctcttattattttgagatacgtcccactaatacctaatttattgagagtttttagcatgaagcttgttgaattttgtcaaaggccttttctgcagctattgagacaatcatgtggtttttgtcattggttctgttgatatgctggattacgtttattgatttgcatatgttgaaccagccttgcctcccagggaggaagcccacttgatcatggtggataagctttttgatgtgctgttggattcggtttgccagtattttattgaggatttttgcatcgatgttcatcagagatattggtctaaaattctcttttttggttgtgtctctgccaggctttggtatcaggaagatgctggcctcataaaatgagttagggaggattccctctttttctattgattggaatagtttcagaaggaatggtaccagcttcttcttgtacctctggtagaatttgtctgtgaatccatctggtcctggactttttttggttggtaggctattaattattgcctcaatttcagagcctattattggcctattcagagattcaacttcttcctggtttagtcttgggagggtgtatgcgtccaggaatttatccatttcttctagactttctagtttatttgcatcaaggtgtttatagtattctctgatggtagtttgtatttctgtgggatcggtggtgatatcccctgtatcattttttattgcatctgtttgatgcttctctcttttcttctttattagtcttgctagtggtctatcaattttgttgattttttcaaaaaaaacagctcctggattcattgattttttgaagggttttttgtgtctctatttccttcagttctgctctgatcttagttatttcttgccttctgctagcttttgaatgtgtttgatcttgcttctccagttcttttaattgtgatgttaggttgtcaattttagatctttcctgctttctcttgtgggcatttagtgctataaatttccctctacacactgctttaaatgtgtcccagagattcgggtatgttgtgtctttgttctcgttggtttcaaagaacatctttatttctgccttcatttcgttatgtacctagtagtcattcaggagcaggttgttcagtttccatgtagttgagcagttttgagtgagtttcttaatcctgagtcctagtttgattgcactgtggtctgagagacagtttgttagaatttctgtttttttacatttgctgaggagtactttacttccgactatgtggtcaatttggaagaggtgtggtgtggtgctgagaagaatatatattctgtggatttagggtggagagttctgtagatgtctattaggtctgcttggtgcagagctgagttcaattcctggatatcattgttaactttctgtctcgttgatctgtctaatgttgacagtggggtgttaaagtctcccattattattgtgtggggagtctaagtctctttgtaggtctctaaggacttgctttatgaatctgggtgctcctgtattgggtgcatatatatttaggatagttagctcttcttgttgaattgatccctttaccattatgtaatggccttttttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacgctgatgggtcttgactctttatccaatttgccagtctgtgtctttcaattggagcatttagcccatttacatttaaggttaatattgttatgtgtgaatttgatcctgtcattatgatgttagctggttattttgctcattagttgatacagtttcttcctagcctcgatggtctttacaatttggcacgtttttgcagtggctggtactggtttttcctttccatgtttattgcttccttcaggagctcttttagggcaggcctggtggtgacaaaatctctcagcatttgcttgtctgtaaagtattttatttctccttcacttatgaagcttagtttggctggatatgaaaatctgagttgaaaattcttttctttaagaatgctgaatattgacctccactctcttctggcttttagagtttctgctgagagatccgctgttagtctgatgggcttccctttgtgggtaacccgacctttctctctggctgtgcttaacattttttccttcatttcaactttggtgaatctgacaatcatgtgtcttggagttggtcttctcgaggagtatctttgtggcgttctctgtatttcctgaatctgaatgttggcctgccttgctagatttgggaagttctcctggatcctactctggggaagtatcctgcagagtgttttccagcttggttccattctccctgtcactttcaggtacaccaatcagacatagatttggtcttttcacatagtcccgtatttcttggaggctttgttcatttctttttattctttttcctctaaacttctcttctcacttcatttcattcatttgatattccatcactgataccctgtcttccagttgatcgaattggctgctgaggcttgtgcattcatcatgtagttctcgtgccatggttttcagctccatcaggtcctttaaggacttctctgcattggttattctagttagccatccgtctaatcttttttcaaggtttttaacttctttgccatgggttcaaacttcctcctttagctcggagaagtttgatcttctgaagccttcttctctcaacttgtcaaagtcattctccatccagctttgttccattgctggtgaggagctgcattcctttggaggaggagaggcgctctgatttttagaattttcagtttttctgctctgttctttccccatctttgtggttttatctatctttggtctttgatgatggtgatgtacagatggggttttggtgtggatgtcctttctgtttgttagttttccttctaacagtcaggaacctcagctgcaggtctgttggagtttgctggaggtccattccagccctgtttgcctgggtatcagcagtggaggctgcagaacagcgaatattggtgaacagcaaatgttgctgcctgattgttcctctggaagttttgtctcagaggagtacctggccatgtgacgtgtcagtctgcccctactggggggtgcctcccagttaggctactcagaggtcagggacccacttgaggaggcagtctgtccattctcagatctcaagctgtgtgctgggagaaccactactctcttcaaagctgtcagacggggacatttaagtctgcagaggtttctgctgccttttgtttagctatgccctgcccccggaggtggagtctacagaggcaggcagtcaggcctccttgagctgcagtgggctccacccagttcgagcttcccagccactttgtttacctactcaagcctcagcaatggcgggcacccctctcccagcctcgctgccaccttgcagtttgatctcagactgctgtgctagcaatgagtgaggcttgatgggcataggaccctctgagccaggcatgggatataagctcctggtgtgccatttgctgagactgtcggaaaagtgcagtattagggtgggagtgaccctattttccaggtgccatctgtcacccctttccttggctaggaaagggaattccctgaccccttgcacttcccgggtgaggcaatgcctcgccctgcttcggctcacactctgtgcactgcacccactgtcccgcacccactgtctgataaaccccagtgagatgaacccggtacctcagttggaaatgaagaaatcgttcgtcttctgcatcattcacgctgggagctgtagactggagctgttcctattcagccatcttggcttgggaccagagaacttcgtatttcttacagcacctcctaagtgttatgttttgttgcagatccgccagatattcctgatgaagtaacctgtgtcatttatgaatattcaggcaacatgacttgcacctggaatgctgggaagctcacctacatagacacaaaatacgtggtacatgtgaagaggtaggtcacttcctcacggcttcatataagcagttccaccccagttcagccagagctctgcctccagcagagatccaagaaatcagcctcaaacattaaatatataccctgatttatcccttatttcctacttatgatcagtgaaactaccaaagcccttttcaagccattaatattttcactctggcaggcaaagtgctctatgatctttctgtcctttttattcattagtaggtaactggtagcaggctcctaatggtggtacagcctagcacagttttaagccattgcttaggacgggcacagtggctcacacctgtaatcccacactttgggaggccaaggtgggtgaataacctgaggtcaggagtttgagaccagcctggccaacatggtgaaacctggtttctactgaaaatacaaaaattagccaggcattgtggcaggcatctgtaattccagctgctcaggaggctgaggcaggagaattgcttgaacccaggaggcagaggttgcagtgagccgagactgtgccactgcactctagcctgggcgacagaacaagactccatctcaaaaaataaaataaaataataaattattgcttaaatccctgctctattcttcttctagggtttcaacaacttaatttccccgaattgctattatttttaatctttaaatgggcctaaaaataaaacataacacacaggtttgttctaattaattatgtggaatttggcttttaaagtgtatataattatgccatattaccactaaattcatggaagctattgttaataatgaccctcagatcttaaatttagtgtctacatagctgatcaactttcctgtttgccttatactaagggggttttcaggacaaaggattttcagttttaaaacctggaaagttgtgggcaaactaggacaagttgcttaccttatccgtgtttcttgttttgtttagtttattaaaaaataaaattccaggccaggcatagtggctcatgcctgtaatcccagcactttgggagactgaggctggtggatcacccgaggtcaggagttcaagatcagcctggccaacatggtgaaaccccatctctactaaaaatacaaaaattagctgggcgtggtggtgggcgcctgtaatcccagctactcaggaggctgaagcagggagaattgcttgaacccaggaggcagaggttgcagtgagctgagatcacgccactgcactccagcctgggcgaaagagcgagactccatctcaaaaataataataaataaaataagatgccggctgggcgcggtggctcccgcctgtaatcccagcactttgggaggctgaggtgggtgcatcacctgagatcaggaatttgaaatgagcctggccaacatggtgaaaccccgtctctactaaaaatgcaaaaattagccaggtgtggtggcacacacttgtaatcccagctactggggaggccgagacaggagaattgcttgaactcaggagacaggagcttgcagtgagccaagatcgtgccattgcactccagcctgggcaacaagagggaaactctgtctcaaaaaataaataaaataaaataaataaaataaaataaaataaaataaaataaaataaaataaaataaaataagccttctgtggtgttgttgaagtatgcttttttttttctgtcactaattcttaaaaatttcacaaaccattttgtaaagcatttattggacccttactgtttgccaagcactgggccaagagctttataaatgctgcctcatttaataccctatacaaccatgtgaagccctgggatcatacaaatgcttatatcctcctaaaattcatatgttgaaacaaacccccaatgcaatagtaacaagagttggggcctttgaagtgagattaggtcatgagggtaaagccctcatggatggaattattgcccttccataagaggcctgaaagagagcttgtttgcccttctaccctgtgaggacacaaccagaaggtgctgtctgtaaagcagagagtgagccctcaccagacactgaatctgctgatgccttgatcttggacttccaagcctccagaactgtaaacaataaatttctgttgtttataaattgcctagtctaaggtatttgtatggcagctcaaagagactaagacagctgcatacaattatttttcccatttgtatagacaagggaactgagacttagtgaggtcaggtaatgaatgtatccaggaccacacagctgcagagaaggagaggtggaatttgaacataggttgcctgactgtcttctcaacttattttctgctgaaggtgtgtggaggaccagatcgcagggcatatttaagatattctactcagttctcatcattatggaagggaataaccttctttttaaaaaaaatctttttatttatttatagggtttttgttttgttttgttttcgtttttgtttttgtttttgagccacggtctctgtcgcccaggctggagtgcagtggcacaatctcagctcactgcaacctctgcctcctgggtttcaagcaattctcccagccaccaagcctgatctctatggaagagaataacctaatcttgctctctctctccactttttggatactcagaataattttgattaagtgaaacctaaaaagaaacacctcatcagtcaagaaagtccacgtagaaactagacagattttatgaacacattgccaggcctagagttaccagctacatgccattggcaagaggcgtacacctttcattctgaacaggagttaaacagaggcatattctggtaccaaagaggtgatgaaaactctgatatcagggatgggtggaattgattgaagagatgcaatatgctaagtactgtgctctgtacttcatgtgcatgacatcttcaattctcaacttaaccttgtgagggaactatcgttattgttcccattttacagatggcgtggggagctcacattacctctccaaagtcacttgactaagaagtaaaggagcagggattctaacagggatttctctggctacaccactggagactaaacctctaccccttgcctatagggtaaagtagaaaagccatgagagcaagacaactagagtctcattgctaagtcaactttaggaatgtgaaggtgagggcagtatggcagcaaactttgcacttcaagcacacagaaaaaccaggcagtgccagattgacagagatagcctagtgtcttgaggatcttcactatctcccagaacctggaaggatctcctgaactgcttatcctggttgtttggttaattcattctttcttttatttttaatataaccctttattaagtataattcatctaccatacaattcaccttatttaaagtatatcattccttgagttttagcacccatcactacaatcaatattgaacattttcatcatgccaaaaaaaaaatcacatccatgagcagtcacttcctatttcccctcaatcttcccagtctatggcagccactatttgctttccgtttctgttgatttgcctacactggacacttcatgtaaaaggaatcatataatatgtggtcttttgtgactggcttctttcatttagtataatgtcttcaaggttatctatggtgtaacatgtatcaggctggagtgcaatggtgtgatctcggctcactacaacctctgcctcctgggttcaagtgattctcctgtctcagcctcctgagtagctgggattacaggtgcacgccaccacgcccagctgattttttttgtattttagtagagactgggtttcaccatgttgcccaggctggtatggaactcctgagctcaggcaaccctcctgccttggcctcccaaagtgctaggattacaggcataagccaacgcgcctggccctttattcctttttttaataatgttccattatttggaacacattttatttatttattccttggttgatgaactttttggttgtttccacttttcagctattatgaattattcttctattaatatttgtgtacacgttttgtgtagacatatttttatttctcttgggcatatatttaggaatagaattcctgggtctcttggtaactctatgtttaatcttttgttcaactgccataatgttttccaaagcagccacaccattttacattcccaacaacagtgtataagggttccagtatctccacattcttgccaacctttgtttttatcttggttattgccatcctagtggatgcaggttaattctttcaagcctgacttacctgccttctgaggttcctgatagtaaaactgcattgcaaattccagacagatgaaccacaatttgaaaaaatatatttgttggatacaattttaaacttgctaacccccacctaatttcctatttagtatcataaaaatattttctgaatattttatatgactatgtattatatatttcttttaaaatcctttaatgtgttcaaaattatgtatgtttacatttatttacacatgacttttgaggaacacattcactttataaagtaaggaatatttgtagtagttatgagtactaagattgttctcagtactcaaaaagtcactctgaaagtattaagaatgagtttactaaagagaatgctttcagaaatattcattgggaagagcatgggctttagagttttagatttaatttccagttctgaaacttaccagtcaggtgtcttttatgatacaaatatcagaaaactcaagtgctggccaggcgcagtggcacacgcttgtaatcccagcactttgggaggctgaggcagatggatcacttgaggtccggagttcaagaccagcctggccaatatggtgaaaccccatctctactaagaatacaaaaattagcagggcatgtaatcccagctacttgggaggctgaggcaggagaatcgcttgaacctgggaggtgaaggttgcagtgagctgagttcatgccattgcactccagcctgggctacagagtgagactccatctcaaaaaacaaaaaaataaaagaaaaataaaaaaactcaagtgcagtcacttaaatagacatggacttatttatatcaggtcataattatatgtagtaacagatggcatgataattcagtaataccccagggatctaggctcttttcctctttctactctgccatcttcagtgtgttgaccttaatcttcagatgctgtatctccaggcttcttatccaagttccaggcaggaaaagtggtaaagagcaaaggagttcctcctgtggacttcgacctacactgagttggccacaacagtgtcacatgtctactctgtctggatgggaacctggcagaagggcattgtaaatggagttggataccgtcatccaacagtatctgccatagttgctagctgtgtaatcttagaagagttatttagccttgctgagcctcagcctcctgtgaaatgaggataattaatgccacaaagcttataaaaaagcaaattataggaagtgacttgcatataggaaatgcttagaattaagtacaacacaaaatgatgtcttagtcccttcaggtgactatgacaaagcacctagactgcgtaatttgtaaaaaacagaaattcgttgctcacagttctggaggctaggaagtcccagatcaagtgtcaacagattttgaaggtctgttcttcatagatggtgacttctatatgttctcacatagtagaaggggccaggcagctcccttcaacctcttttataggggcactaaattgattcatgagggaaaagccctcatgacttaaccactttctaaaggccccacctcttaatactattacattggggtttaagtttcaacatgtaaattttgagggtacactaatattcagactatagcaaaggatattataatattatggcctaagggaaacctgaccgatttgattgagggaaatattaatgtaaagccataaaaattattatttataggatattatagataattttattcatatatttttaagtaatacaataattttggaaaaatctagaaagagatgttgcatgtgctctaatagaaagacttattttttgtatgtcaatagtacatttattcattcaaactagaatgtaggcttaatgtgggcaagaatttttgtttgattttttcattgctatgttgattgaatctagaatggggcctgacacatagtaaatgctcaataaatatttgttgagtaattattctagttgataactagaaatagacatttcctgaatctccccttcactgtctagttaagtaataatataaggtcatatatattttataaattatttttcccatcttctttcttaaaatccaacaataaactataaccaaactctgataaacctaaccaagttctgaattgatggaggccagattaatgggattttattacattctaaacaggacataaaagatataaaaggttagaataaaagtgaatgttctcctctagaaaagtcaaaggactaacttataaatatagacaggtcagaaaaggaaacaaacacctatttatctaatgattagttacaaacaaactaatgagttgaaaaaaattagagaagagggctgggcgcagtggctcatgcctgtaatcccagcactttgggaggctgaggcaggtggattgcttgagctcaggagtttgagaccaacctgggcaacatggcgaaaaatacaaaaaatataaaaatttctacaaaaaatacaaaaactagccaggcgtgttggcgggtgcctggagtccaagctacttgggaagatggcttgaacccaggaggcagaggttgcagtgagccactgtactccagcctgggcgacttagccagaccctgtctcaaaaaaaaagaaagaaaagagcaagtcaatttccctaactaccagaaaaaatctttccctcaaggagaaagctgacttataatgaatgttgtggtcgaggtagtattatgtttaaaggagctcttctaaacgttcagttattagggtattttccacattggtaactaggcagagatcagcatgtgcaaggtttcacttctaactcatgtggttcagttttccagtaaaatcacatgtagagagaagctttttacctgagaccacctactcatttctccagttgcagaaaggcagtgtttcccctatggcaacataggtgccatcacaggcctcctcatgttggggtgaagttgtaaagtagaattttgtctgttttgcttcaagagctttctttcttcccagctcctttgcggtggcctcaccagacagagcctcctggctgttcacataccttcttttacctcctgtattttgctgtttcaaagggtaatgatagggaaaaaaaaaaaccaaaaaaaaaacaaaaccagtgctaataaccatctccctactgtagtcccactatcttcagcaatttcatgtaaatatattttttatttatcttggaaacactggtaatgtctggctcagtgtattctactccataaatatttgttgaataaaaatgcatgaatgatagccctgcattctgttccattcaagtcatcttagcaaatatttatttagcatttgatggtttcctggaattgtattaaactgtagatatttaaaaaaaagagatcatctctgtgcatgacaagctcataaacagtttagaataacatcaatgttgggattttcacgcaccgtagaagaccaataaggcaaatgttttcagatgcagtatcatgttagagcccttaaattcagcggcctactctgctaattcataaggcctgtttgtttttgccacagcttctctacatgcatatttttaataaccagaaagagttcttaggtgtgattccaaatactatttttaaggctacgttaggtttcagtaattcctttaggactcaaaatgtagtttatattttagaatccatttcctcactgattatgagcccagagagctaattgtggctggagacaaacagaaccttgctgactgatactgctttatattcatgaccactaacctcaactgggcccggagagccacacagtaatcctactacatttcactagccaagtcactgtcttgctaagccaggtcattgcttcattactttttctgtcatctctcctctctagtatcttcccttcctcactctctattgaagacctgcttcctactttcctgagaaaacagaagcaatgagaaataccacagcctccctcattgactaatgcattgacatctgtacccatatagttgatctttcctgctattgctatggatgaattaccattgccctaaggtcaactctccacttgggtactagatcttatcctgcctgcctactggaggacactgctccaaaactttcctctcttccttctgcattgtcattgtctctgtctttactggatcattcccattggcttttaagcatgctgtagcctttgcccttttgaaaaatataaccctccctttgttcctgacctctaccacccaatttctctgtttctttttatgaaaaaaaatcaaaagagttgtctgcactgtctgtctctattttctctcttctcttttatctagtttagtcatgttttatgtcctcaccactccactgaaacagctcctgtcaaagtcactgatgatttccccattgccagattgaatggcttattctcagtctttatcttacttatgaaacatttactatccgagcatttaatgtagctcttcacttcctccatttggcttccaggacaggactcccttttgctgctcctcccaccttcctggaaactttatctcagtctcttttgctgattcatcttcatttcagataaattcatagtgacccagagctctatattttgtcagcctaaaaaaagacactagggaagattatcttcaaatttgttgggtttacttgagaatataaataaggagtataatacagaatgcatgacatggcaagccagcagtgcatttggtgagggaaaggataaagggaagcttttattaccaaaaaggaatatatgtgagctatttaggaacagagttcattagttccagaggctcaaagccagagtgattgtcaattaataagtggagatgtattactgggtaagcggtcttccaaaaacatcttatctggattactgcagtcctaaaggatgtctagtgataaaccttatcaaagcaggggatgactgaaaggtttttagaaagtccttgggaacagttcttatctcagacatgtaagcatgggcctcttctccttcaggcctttcttgccctattttgtctgggtctgacaaaagtgatttcatcctggtatgtgcaactttcacacctaggaccttttattatctctatttacagtcattacctaaaggatagccttcaaatttgtggtttaaaattcctcaatgtatatctgtgtctaaatatctccaccaaatacagctgccatgtttctaacctgtcattcaaggtatcttgaagttaacattttcaaaaccaaacacccagtttcctctcccaagacttgcattttccatttcagtaaatggcaactgtatcctttgcattattcaggtcaaaatcaggtagattctcctggattcctctctattatggccttcatctaattgatcagcaaaaccttccggctctatcttttaaaatgacctcaccacctacactgcaatccaagccagatcatctctcacttgggagtataagaacttctaactggtccactcgcttcctccagagtcccttattcatgagttttcacagtaatccttttcacatgcacctcaggccatgtcacccttctgctcatgaacctcccatttcattcagagatcaaagccagagtccctcaaggactctatgtgaccttgcaagtcttctaaactttcccctcttccaaaactctctgattttgtctttaatccctttcctagtaaaacctcactgacctccttgctgctctttgaacaggccaagcaaggtcctgcctcagggcctttgcatgttacctagaatgctcttcctccagagagccacagggtttccttattgccctaatgtcaccctctcagataagactttcctcatctctctaaaaaacaaaaaccttaaaacccacccctactctcagaactgcctaacctttttactccgctttagttttcttctgaacatttctcaccatacatagatcagattctatatttatttgtttccaccaaaatgtgtgcttcatgacagttgggactttatctgttttgttcattgtagccccaatatctaaaaatatacttggaatatagtcagtgttaaataaatatttattgaatgagtgattaaatgaatgaaagacactatttaccattatcaacataaatctgcaatgttttttgaaaatctataaattacaactatatctaggtgctcagggaacatcagaaaaatatgaattatactaactcccttcacaaatcatctgtcatgtattagcccatgaaaaaaagaaatagaaataagatattcaaaaactttgtaatatacagttatgtaaaagatagaggaaaaaccaaagtgttgttctcctttctactctcaacagcactcctgacacgaaatgtgggaagattttccccacacaccaatcaattctcctgcagacatcagctagatgtcctctaatttaattcaattctgactctgtctacctggaggtagcatcagatcccacagctaaaggctcagtcccacaagactcaaccctgttttaaatgtcaatcacaagccccaggtcatgacctgtgcttttgaccaaccggctaaaaattgtggtttccacgatacactcctcaggtttgattaacttgctagagtgtctcatagaactcaggaagacactttacttatatttatccatttattataaagaatataacaaaggctacagatgaacagccagatggaagagatgcatggggcaaagcatgcgggaacaccaccctgcaggcatcctcatatgttcagatatctggaagctccctgaacccagtccttttgggttcttatggaggcttcattacataagcacggttcatcatatcattggccattggggatcattcagcccttctctcttcccaggagatgggggtgggtaaagggcaagggggttggggggactgaaagtttcaatcttctcatcacattgttggttcccctggcaaccagcccctaccctaagcctatccaggagcccccagccatcagccatctcattagcactttggagattccaagggttttaggagctgtgtgctgggaaccagacagaaaccaaatatatatttcttattatgtcacaatatcacaagttctatataaaaataaccctaaggtgtaattagtcattattatcagattcttcaattaaaacagtgctttgtggtctaggtgctaatatggggtagactttaaaagcagaattaaattacttagtaactatggttactgtcagtttgaaaatacatttccattttgacttgtggtctcagtatgtgtggtaaaagaattagccacaaaccaatgaagaacatataatgtggttttctctaactggaaaatattcaaagatgtcctacttaccatttacacatagttgccattttcttgttttcacatttgaattcttacttagcatgaggttaacatactttaacaagttctctgttaaggtatttacgtttcatcttatttcagaaagaatataaggtaactatgtaaacatctcaatttaacggcataatttaacttaagatacagtgatataagagaaattttactggtaagaaatatagcaattttaaaagtttcatttgtattctttagaatgtgtcaaagtcacatatcataaatatcttctttttttatttaaatggacacatagtctcactctgtcatccaggctggagtgcagtggtgcaatgttggctcactgcagcctccatctcctgggctcaggcaatcctcagcttcctgagtagctgggaggacaggtgcctgccaccacacctggctaatttttgtatttttagtagagacagggtttcaccacgttggccaggctagtctcaaactcctgacctcaagtgatctgcctgcctcagcctcccaaagtgctgggattacaggtgtgagccaccatgcctggcctcagccagtatctcttaattcagaaaaattgttgtttaatgagtccttcattaggtgagaagccatctactctgtttcttatttaatttactcatgataacaacaacgttatcattcctatactgaggatgagtaaactgagctgtatagagcttaagtaacttgctccaagtcttacaacttatcaaggggcagagctgggatttgaaggtaggtctgtctctaaaatccaagccctgtgattttagtcaccatgacataccctcctcgtcctctcatggtgttcatagtgatctcacgctggtatgaggaaagaggtaacacagaaaaaatgcactggaaccgaaaaacctgagctgaataggaggagttgctcctcacccctccaatgactatcagccttagagagattccttgaccacttgctgaggttgtcttgttctgatagtagcaataagtttatataaattatataaaatatagaatttctatagtacttagatgcacacatctgcttattgcttggtattaatagcataaggctggttccttttctctgcgtctcagcaagcacgtttcttggattccaaaagatgtaagtggctagcaagtttaatcctggtgggatattttggggctagaaaaatttaggagttgctgaaaagatatatagtagtaacaggacttggtggagccttggtggagggacagtgatttttaagctttatcttctccacaaatccaatcaaggcagtcccctgagagagagggcagttgatggtattagatttaaaaaatcaggttagagtctgcctcaacagcacaaacagtgtaattggaacaagacaaagaagatggcatgacccctgatcaaggacggcatgcaaatttgtgaagtatttccatttgatacaaataagaatgtatatggctgagcacggtggctcatgcttgtaatcctcacgtgggaggatcccttgaggccaagaatttgagaacagcctgggcaacatagcgaggctgcatctcttaaaaaaaaattattttaaataaaaaaattagttaggcctggtggcacatgcctgcgatcccagctactcaggaggctgaggtgggaggatcacttgagcccagaaagtcaaggctgcagtgagttatgatttgtgccactgcactcaaacctgggtgacagagtgagaccctgtctctaaaaaatagaagaaaataagaatgtaggctacttggctttccagcattgttcagatttcaaggttactttccttctaaagtagtatatctatatcaagttaagtttcatgatgtaatgcaattaacttaggagtctgaaagtcataaaccaaacaggtaacaaagacctagaccattgccatagctatcaaaacagggaaaaaagataacataggaaaataatattttaatgcttaaaaaaatgcttaaccttctttagtaattggttggctcttaaaggtgacgaagagaaaattgttaaaaatggcaaactgagaaaggtggaccgcatgcctttgacaacaatgaagacactggcaagaagtgctgatttgcatggaaagataatttagttgtcagttttctatagttctggttccagtcagacatccaaatgaagctcccagtgagggcacaggtatgcgtgagacacacatgtgaaatagcaggtgaagctgagaagggagtgagcccagaaaaaggggtcagggaaaaggcaaacaccagggctgaccttcaatgtgagtgaactcagagagtagggaaagaaacccaggtggaaggctggagggggacatgccactaagtaggtgtgagagaggaaggccctctaacccagaagacaggctttgggtagcaaggaagtgagaattataaccaatcaagagggataaatgcttaaatgaggattcagaggacttcaccttgtaaaggacaccattttaaaagagcagtttcaaggaaaagtaaaggcaaagatcacaataaaaggactaaagaccaaatgggaataagttggatgtagttactaaggaggtagaaaatctgagaagcttaagaacatgaaataatggagtaggtagttcaaggggctcaagaaatgggaactgaggaaattctagtgaaaatacttccatgttacaaatgaatctgattacagattatgttgtgttttggagtctgaggggggccctattcatctctgcagaagaatgagtgaacaaggggtgggacaagaggctaggagatttgaggacactcctgtgttagtccattcttgccttgctataaagaaatatctagaccaggtgtggtggctcacacctgtaatccctgaactttgggaggccaaggcaagaggatcacttgagctcagagctcgaggctggcctgggcaatgtggcaaaaccctgtctctacaaaaaattagctgagagtggtggtgcatgcctgtagtcccagctactcaggaggctgagatgggaggacctcctgagcctgggaggtcaagactgcagtgagctgtggccataccactgcactccagcctgggtgacagagtgagaccctgtcattaaaaaagaaaagaaaagaaaagaaaagaaaagaaatacctgaggctcggtaatttatgaagaaaagagttttatttcagctcacagttctgcaggctgtccaggaagattgtgaacaagatagagggaggggggatatgccacactctttaaaatgaccagatctgcctgaactcagagggagaagtcactcattactgccaggagggcagcaagccattcatgaagggtctgccccacaagtcctcacctccaacactggtgatgactttgcaacatgagatttggagaggatgagggtggaaacaatatcaaatctcttcacagaaatcagaggagcaaagaagcattctccagcactcctttcgccaccgcctccaaccctcgtccactaaaaacatcatgtgattatttaggggtagagatttaaaaacagaggctcaaacattctgtccaaagccagtgaaaacaatttgaaactctggcattaacagatatcattcggaattctaccaagtttattgggctacttggatattctcattcaattataaatacttagataaatatgctttgaaatgatacttaatagccctctctattcccctgttctaaactagatctttcctctttatcttttccatcctcttccacagtgcatgactccctttcccctcatcaaacctgtcattaggtccagtcagttctacactcaaaatccttcatgggttgggcgaggtggctcatgcctataatcccagcactttgggaggccaagacgggcagagtgcttgagttcaagagttggagactagcctgggtatcatgggaaaaccccatgtctacacaaaatacaaaaattaattgggcatggtagtacgtgcctgtggtcccggctactcaggaggctggggtgggaggatcactcgagcccaggaggtcaaggttgcagtgagccaagatggccccactgcacgccagcctgggtgacagagccagaccctgtctcaaaatccttcatatccacccccattggcttccacctatttcagactaataatccaattctggattattgtatagccttttgatttttccactaccaccactttcatttcccacaaatcctccgtaaaggtgctagacagtcccagagaccctcaaaatagtgtgaatctcactatatgcactcactttctatcacttacatgatacagtcctgatccatcagtagctcatggaaggtcttctgacaggcctgctccactacaagtttcttcttgcattttcaggatccaggctattgcacttgttgaaccttctcagaaatgtcatgttatttcacgtatttgtttcagaacatgctggttgtctctgtccaggaggttggccttccccctaccccattgcgatctctcaccccatcctgactcctccccaccactccatcctcaccctatgtcctgatagaaatgtctgacttcacagtccttgcactgaaccaaaatgcagtgctcttttccaaaggcagctattctggctattccaagctatgtccagtgccgacttccctaacaggcacagtaggcacagtggctagggcccacaataattttaggagtccatgaaaatgtttaattttacttaaaatcagaagagaaaaataactgttatgttcatgtatatgcatgtatatggcatgcatatgtatacatctatgtatatgtgtgtatatttttgtgtattttatatatttatataatatatacgctcattgtttttttaatggaggaaagggtccatgaaggcagaagtgttcagggcccattgaaatcatactgtggcccttgtcagatttgaatttattttttaaaattgtgaaaataaaatcaattttgaaatatttttcagtaaaaggttgcatatttgaaagcaggcttaaaaagttagcgtttttgtccaggcacagtggctcatgcctgtaatcctagcactttagaaggctgaaatgcacggattgcttgagtccaggagtttgagaccagcctgagcaacacagcaagaccctgtctctactgtttagaaaattaaattttaattttttgtttttgtttttgtttttgagacggagtctcgctctgtcgcccctgctggagtgcagtggtgtgatctcggctcactgcaagctcctcctcctgggttcacgccattctcctgcctcagcctccccagtagctgggactacaggcacctgccaccacgcccggctaatttctttttgtatttttggtagagacagggtttcaccatgttagccaggatagtctcgatctcctgaccttgtgatccgcccgcctcggcctcccaaagtgctgggattacaagcgtgagccataaattctaattttttttaaaaaggtaacattttaaaaatctggaataattaattcaaactttttttcttttttttttttttgagacagagtctcactctgttgcccaggctggagtgaatggcgtgaccttggctcactgcaggctctgcctcccgggttccagcaattctcctttcgcagcctcccaagtaactgggattacaggcacatgccaccaattattgtatttttttaatagagacagggtttcaccatgttggccaggctggtctcgaactcctgacctcaggtgatccaacccgcttggtctcccaaaatgctaggattacaggtgtgagccaccatgcctggccaattaattcaaactaaatacaatttatgatcatcttttttttttgttttaagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatataggtaaagaataagaaattctgtaagtctttaataataaccagtttgtgctgaccttgtcaaatgaggtctagatctgaaagaagttcccctaaagttcctgcagagcatgataaaagaaacagaaattacccataattctacctgcccaagacaacttagagatgagtagtgctgctgccattttgttgtatatccttccagtcttatttctaaattgttgtatgtggctgggccggtggctcacgcctgtaatcccagcattttgggaggtcgaggtgggcgatcacttgaggtcaggatttcgagaccagcctggttaacatggtgaaaccctgtctctactaaaagtacaaaaaaaaaattagccaggcatggtggcgggcacctgtagtcccagctactcaggaggctgaggcaggagaattgcttgaatctgggaggcagaggttgcagtgagccaagattgtgccactgcactccagcctgggtgacacagcaaaactcttgtctaaaaaaaaaaaaaaaaatccatatatgtgtttttacaaatatttattggaaacttcttattttcaagcattgttctaaaggctagagtgaataagatagacaaggtgcctgccctgaaataacttacaatctactagggaaggcaaaaaaaaaaaaaacaaaaaaacactatgatcatgataaagtttgttgagtcttacgttgtgaaaagtacagcatgctaaattcttatactctatacactacttggggacttatgtaaggtttttttgtttgtttgtttttattttgaaaagttttacaaaatacatagaaaattgcagagaattatgtagacctctctatgttcatcagccagatttaacaaacattaatagtttttgtttcagatattttataccctgcctttttatacttatatattagtaataaacatttctattaatttaatctatagttttatttttaatgttgtctgaatatatagcagtttaatccctattgttggagattaacactgttttcagtttttaaccatataaactatattgccatgaacaactttgtggctgaattttagcatagtttttgattgtttccttaagataaattccaaaaagtaattacccttgagccttttacaactacatccaagtcctaaaaccacaattcagccaaatgacaccaagtctgaatcatcctgtctttgcagatcccagtaccaatgattcctgttgttataattaaagatatttcaataagctaacatttattgagcactttcttatgtgctaactactttttctttttttgaggcagagtctcactctgtggcccaggctggagtgcagttgcacaatctcggctcactgcatcctctgcctcctggcttcaagcaattctcatgcctcagcctccctagtaactgggactacaggtgtgtgccaccatgcccagctgatctatattgccacaaagttgttcatggctatatagatttttgtatttttagtagagatgggattttgctatgttggccaggctggtctcaaactcctgagttcaggcaatcctcccacctcagcctcccaaagtgttaggattacaggcgtgagccactgccagctaacagcttttcacatacgttatttaaccctcatatcaaccctattttgtagatgagattataatttatatattagaaaactgaggtttgatggcattaaaaaatttgagatcacagaggtagggaacatttaattcaggggatcctcctgccttagcctctcgagtagctgggacgacaggccacaggccacagtgcctggctaatttttttaaatctcttttagagacagagtctcattttgttgcccaaacttgtctcgaactctgtggctcaagcgatcctcctgccttggcctcacaaaatgctggtatttcaggcgtgagccaccatgaccggcctgaatattagatttgaaaacacactctgttgaatatgatgatggacaattattccattttattgtatatccttggagttacagttctcttgactatgctctatacatttttgtgaatttacattttgaggtagaatgcagtaatatacccttttcttacgatagataaattaatgatgtttaagagctatcatgaccagtatcattttagcagtgcaatttttaggaactaaataataataataatacttgtattattattaccattctgatcttaatatcattgcatcaatttatttagcaccttctgtgttccagacacctctcatgcacatcacgtttcattctggaaacaaccatacatgatactactgtccccattttacagatgaagaaagtgataaaatgatttgcgcaaagtcacttagctagtaatgaggaaagccagatttcatcccagacatgctgacttgctatagtttaccaccatcccacctcccacaaaggaaaaaatcccatctggcctctacttccagactgacttctcacactgggaactaggagtttggagttgtggttccttttccttcttctccttctttctctttccctcctcctcttcctccacctcctcctcctccacctcttcctccccttttgtctctattcctttccttgccttttcattatcccagaatgtactcagaaactcaggttgaaaaatatggattaattgtataggaggccccagccaacaaaaccaccagattattaacagatgagccgtcttcatgggtaacactttaagaatgagacaacgcaaattagataaatgaactgttctatgccactgagaacagaagactgtcctgggaacaatttccacatagcagctacgggctgggctttaatgacattagggaggttatgctgaatggcagcgcagagttagtagcacattaacacttgccaaaaaagcatatgagaggaatgcttttaacttctcttgtagggaaataaattcgggtacagaaattgctgtgctttctgcctgccattttgaatattacttctccccattatataaatatggataaatatgtgttggaaagatgctaaaaggctataatctcgcttttatttcaatacgagtagaatttaaaaatatgacatctataataaaattgatactttttttttctttttttgagacggagtctcgctctgtcgcccaggctggagtgcagtggcgcgatctcggctcactgcaagctccgccttccgggttcacgccattctcctgcctcagcctcccgagtagctgggactacaggcgccagccacctcgccccgctaattttttgtatttttagtagagatggggtttcaccatgttagccaggatggtctcgatctcctgacctcatgatcggcccgcctcgacctcccgatacttttttaaaatgtaagatctggtggaaatatgtgaaacctaatcagtaagaataaaaattcaacatctgagtcttgtgtaacaaactaaatattcaagtatgtattacataataaatgccagtttgcaaaaatatgaactcattcaaacttaaagacttaaatctggattgcactgacctgctttatgctgtgattcttactgtgctatctgcatttctcataagactaaacagatttttactttctcctcagaataattcttttgccaaaagggtcctagaatgcttgtgctgctataacagtggccaagccgaactcagaggtggaggtgggtgacaggaggaggtgagaaatttatggccttgagggtgcttaaaatggtcctaagcaatttcagagccccagggatccatgcccttgactctagaatctcaatactgattttttttttttttccagggttggggttgggcagagtcttgctctgttacccaggctggagtgcagtggcatgatctcagctcgctgcaacctctacttcttggattcaagtgattcttgtgcttcagcctcccaagtagctgggattacaggcgtctgccacaacacctggctaagttttgtatttttagtagagacaggtgtttcgctatgttggccaggctggtcttgaactcctgacctcaaatgatctgcccacctaggcctccccaaagtgttgggattacaggtgtgagccactgcgtccagcctgaatactgattcttattacaagaagcttgcactagcaaaaggaaatcagctatggaattcagatgataaaggttgagtacagtaaacttgttaactaaattaaagctactgctacttctacgccaggtgtagcccccaaaattttattagaggactgtgttactagacagcaaatccttaatttttgtttttctctgtaaatcatctacctttgcacataattttagataataatagtataatagtcattgtagtaaaacaataattttcttaaagaaagttttataaacctagaataaatgaaaataaactaattcatagagaatattaacctgtaatagtggtctctaaaaccacgcctacaggcccttgagttctttgttaaatagtacagctatcaaagtcataggttttcattgttccttaggggagaaatggaaagtgttaatgattctattctgttcagacaaaacaaacttacaagtatttacacagtttagaaacatagcgattccaactatatacctcctactataacaaaacaactaataaaataaccaatcagaatttcagttccttctgtgaaggttattattatagaacatgccaacaatttacaaagccttagagtcttatgagatctgctttcttcaaataaaatttcaaggaaggacagatttattttaaaggagaacaaaacaagttagcaatagatataaatattcatatgtttccctaatacacaagagaaggagaagattattgtgataaaagatctgaattgaacatccatctttctttctttctttctttctttctttctttctttctttctttctttctttttctttctttctttctctttttttttctttctttctttcttgctctttctgtctcttcctttctttctcttttccttcctcctttcccttcctttctttcttttttgacagagtctcgctccgccacccaggctggagtgcagtggcatgatctcagctcactgtaacctctgcctcccgggttcaagcgatcctcctgcctcagcctcctgagtagctgggattggcacgcaccaccaccacgccgggctaattttttctgtttttagtagagacagggttttgccacgacgaccaggctggtctcaaactcctgaccttaagtgatctgcccacctcggcctcccaaatgctgggaatacagacatgagccaccatgcccagcctttctttcttttttttgagacaagctctcattctgtcgtccagggtggagtacagttgcaccatcatggctcactgcaaccttgaactcctgggctcaagtgaccctcccatctcagcctcctgagtagttggaatttcaggcacacatcaccacacctggctcaatttaacatcttttcaaatctgatcatctgaactaaatttgggtgcatatcatctctcctcgaacagatggagggaagaggggatagctcctttatctcatttttatactcttttgttaacaaggctaggctctggaattttattagttaggattgtaagggagtgaaaggtgggggaaagacaggactattagagttcagtttttttttttttaatggggaatgggctgaatagaattttccttaacagcagttttcttctatgtaacaaattagcaaataagaaaatgtccataattgttcattagaccatgaattttatttttttttactttgagctttctcatatctagatattgacgaaaagatgccagtttctccctaggcaagttttaaacagccaggtctttttttttttttttttttttctagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatgtaagctcaactttcattatgctttagcatgtgaatgaatgatttaaaagccaaccatcagtggctacagtggacttattatgtctattttacatgtttttaatctgattgtttgcatgatattcaagccactttagtttttgttttataatttcaacttttattttagattcgggggcacatgtgcaggtttgttacctggatatattgcatggtattgaggtttggggtatgattgatcctgtcacccaggtgctaagcatagttaccaataatttgcttttcaacccttgccttcctaccttcctccacactctagtgtggtccccagtgtctattattgccatctttatgtccatgagtacctgatatgatttggctgcatccccaccaaatcgcaacttgaattgtgtctcccagaattcccaggtgttgtgggagggacccagggggaggtaattgaatcatggaggccagtctttcccacactagtctcgtgatagtgaataagtctcacgagatctgatgcgtttatcagaggtttccgcttttgcttcttcctcattttctcttgccaccactaagtaagaagagccttttgcctcccaccatgattctgaggccttaccagccatgtggaactgtaagtccaattaaacctctttttcttcctagtcttgggtatgtctttatcattagcatgaaaatggattaatacagtaaattggtaccagtagagtggggcattgcttaaaagatacccgaaaatgtggaagcaactttggaactgggtaataggcagaaattggaacagtttgaagggctcagaagaagacaggaaaatgtgggaaatttggaacttcctggagacttgttgaatggctttgcccaaaatgctgatagcaatatggacaataaaatctaggctggggtggtctcagatggagatgaggaacttgttaggaactggaggaaaggtgactcttgttatgttttagcaaagagactggcagcattttgcccctgccctagagatctgtggaactttgaactcgaaagatgatttagggtgtctggtagaagaaatttctacgcagcaaagcattcaagtggtgatttgggtactattaaaggcattcagttttaaaagggaaacagaacataaaagttcagaaaatttgtggcctgactatgcaatagaaaagaaaaacccattctgggggggagaaattcaagccagctgcagaagtttgcacaagtagcaaggagcctaatgttaattccctagaccatggggaaaatgtctccaggccacatcagagacctttacagcagcccctcccatcacgggcttggaggcccaggagaaaaaagtggtttcatgggctgggaccagggtcactgtgctgtgtgcagcttagggacttggtgccctgtgtcccagctgctccaaccatggctcaaagggccaacatccagcttgggctgtggcttcagaaggtggaagccccaagctttgacagcttccacatggtgttgagcctgcgggtacacagaagtcagaattgaggtttgggaacctccacctagatttcagaagatgtatggaaatgcctggatggccaggtgaaagtttgctgcagggacggggccctcatggagaacctctggtagggcagtgtggaagcaaaatgtggggtctgagcctccacacagagtccctagtggggcattgcctagtggagctgtgagaagagggccaccatcctccagattccagaatggtagatccaccaacagcttgaaccgtgcacctggaaaagttgcagacactcaataccagcccatgaaagcagctgggagggagactgtaccctgcaaagtcacagggttggagctgcccaagaccatgggaacccacctcttttatcagcataacctggatgagagacatggaataaaagaagatcatttgggagctttaaagttgccctgctggattttggacttgcatgggcgctgtaacccctttgttttggccaatttctcccatttggaatggctgtattacctaatacctgtaccctcattgtatctaggaagtaactaacttgcttttgattttataggctcataggtggaagggacttgccttgtctcagatgagactttggactgtggacttttgggttaatgctgaaatgagttatgactttgggggacaattgggaaggcatagttggttttgaaatgtgaggacacgaatttggaggggccagggatggaatgacatggttttgctgtgcccccatcaaatctcaacttgaattgtatctcccagaattcccacatgttgtgggagggagccaggggaggtaattgaatcctgggagcccgtctttcccatactattctcatgatagtgaataagtctcatgagatctgatgcatttatcaggggtttccgcttttgctttttcctcattttctcttgctgctgccatgttaagtagtgcctttcaccacccatcatcattctgaggcctctccagccatatggagctataagtccaattaaacctctttttcttcccagtctccagtgtgtctttatcaacagcatgaaaacagactaatgcagtacccagtgtttagctcccactcataagtgagaacatgtggtatttgattttctgttcctgtgttaattcacttaggaaaaccactctagctttaataatgattattgtatgcttgcaaacagagaactgtttcctcaaacgatccacttgccttttattagttgctaaatagacaaagctccgactaagaggaatctaattagctatttgtaattcagtgtctcctagggtgaaatttatatcagtgatcatggataaaaaatttaagtattctgtgctgaaatttgacaggcatccagggaaacaaaaattgttcggaaaggagaactaagatgtatgaatgtttctttttaagtgaaaagtgtatagttcagagtgtaatatttattaccagtataggcctgagtcttaggtgagcttaaagatgatgataatccgagtaaaaatgagtttaaaaaagtgaacgtctagagaaacaaactaaccatccttaaatgccaaggttaaattatctagtgtcttaagaaaggcatagctgcaaggttcattaataaagtcacatcagataacagcacctgggaacaacgtaataaaactcagtaatttcagctgtggaggaacactagcctgatttaggaagaagttccaattttgatatattttaaaagaaatgctatttgattatttttaagcgtaacaaactgccatttagtccaaataattaagaaatagtttctggcctttttttttcccttccgatacttttttaaggttttttttttagagatagactctcacttcatcacccaggctgaagttcagtggtgcaatcatagctcactgcagccacaacctcttgggctcaagtgatcctcctgccttagcctcccaagtagctgggactacagtcactcatcactatgcctggctaatttatttttatttttatttttttgtagattcttgccatgttgcccaggccggtcttgaactagcctcaaataatcctccccctggctttctcgtcagcctcccaaagtgctaggattacaagcatgagccacagcacctggcctggcttttcttaattaacagttatgtatcagctgtgaaattaccagttttcagcgcgttaaataaagtgatatgtatttaacactaaaatacattaaacataacttaatttttctttggtgctaagcatgattccaaatccttttgctgtttaagactgattctgagtatcggttttgctatagagtaatatatcttaaaagtatcaagaagatgggggcaaaactatactaattttattatataccctaaaaattactcattaaaagtaaattccttacgtcaacttgtttacctttgttcactcaaatcataaatgtgaactttatggttgtttgcatacacttaaatgggatccacgttctgcatcatttgattgataatcaagtgaagatcctgctgaattccttttgcatatgcagaatttagattaaatttcaaaacaacacaaatacaattctcaagtcctagattctgaattaatggggttttatcctaataagacacctggggtccttgtatagtatcacagtcatagaatgatattaaagaatactgagtttcttaggctgggtgcagtggctcatgcctgtaatcccagcactttgggaggccaaggcaggcggatcacctgagctcagggattgaagaccagactggccatcatggcaaaaccccgtctctactgaaaatacaaaaaatttagccaagcctggtggtgtgtgcctgtaatcccagctactcagaaggctgaggcaagagaatcgcttgaatctgggaggtggaggttgcaatgagccaagatggagccactgcactccagcctgggtgacagagtgactctgtctccagaggaaaaaaaaaaaaaggataccaaatcctcttacttcatgcaaataggagtatgtaatagactagaaaaagtgtttagaaaatagaaaggaattatattatcagtgtctctgaataagttttcagaagccaactgttttctggttgaaactcttattctctgctccccctggtggtgctacataggccatcttggtaacaggtacatttgagctcacttttcaaaaccttctctttatcagaagtggcaaatagagtagaaagaatatttgttatctcatatgctcttcataacaatcctttgtgataggtagtattagctccattatataaatagggaaatagagtttgaaagaagtcaagccagatttttttgaacttataccgtcagtaactaagtgcctctcacagactctacatcactttaaagaccaaataaatatttagaaaatgaaaagacaggtttcaatccaaagccacttctgtctcctccaccattatttttttcagaaagtttttttaaactcatgactccctcagtcaatctaccacgtttcctttaaacacaaccactaacacagaaaaagtgaattaccatttctatccagatcactcaagccaagtcactgtagccagaatgaagctttgtttacatttgctactgtcaatttcatctgggtcatgcatgaagtgttgtctctgcatgtctgtaggaagacaggaaagtcagagtcaagaggagtgggaggataccaaagattacaggtctcttctaccactttagctccgtggtggcattgcctccattagatattgctggaggtggggggtttacttcaaagcgacaggaaagccttgtggccaagagcacaggctctagagttcaaagcctggctctgctactttctagtcatgcaatcttttttttttttttccttttgagacagggtcttgctctactgcccaggctggagcgcagtggcgcaatctcagctcactgcagccttgacctcctggactcaagcaatcctcctgcctcagtctcccaagtagctgaccacaggagagtgccaccatgcccagctaaattttaaaaatttttctgtagagacagggttgtgtcatgttgcccaggctagtgtcaaggtctctaactgctgagctcaagcaaccatcccgcctcagcctcccaaagtgctggtattacaggcacgagccactgctcctggctaagtcatgcaatctttctttttctttttttttctttttagacagagtctcactgtgttgcccaggctggagtgcagtggcgtgatcttggctcactgcaacctctgcttcccgggttcaagcgattctcctgactcagcctccctagtagctgggattacaggcatcgggcaccacgtctggcttctttttgtatttttagtagagatggggtttcaccacgttggccaggctgatcccaagtgatctgcccatctcggcctcccaaaatgctgagattacaggtgcgagccactgcgcccggcctagtcatgcaatcttgagcatgtttcttatcttctctgtgcctcgttattcccatacataacatggggataagataagcccttatatcatgtgtttgttgtgggaaaggggatccaatgatgtaagaagttagctacaagcctggaatagtgtaattgttcactaaatgctagctagtaatgttactctctagcctctaggggagccatgcagcagggatagtagagcaaaggaatccaactgaaagtcacagtattgagggtgcttttcagcccctttagctaaggtacatacagactgtgaagtatctaagggaattaggctgacgaggcaaggagaatatgtgccacgcagcagtccatgtttcaggcaatgatggatggcatatatgatggtggtcccataaacttatcatgcagctgaaaaatttctgtcacctagtgatttatattacaattgcctgcaggattcagtacagtaacatgctttataggtttgtagcctagaagcaacaggctataccatatagcctaggtgtgtagtaggctataccacccaggtttgtgtaattacaatctatgatgttcgtacaatgatgaaatcgcttaatgatgcatttctcagaatgtatccctgtcgttaagtgacacatgactctagttatctcttgaaagatggttccaggtcaaagcttcagattttgtctctggagacacagctgcctctgggagaacatttacaaacatcttgctcccacctcatttacctctctcccttctgaattccctagaagtctagcttagaccaggttggaatatatacagattttagtaaaggctcagagatagcaagaagaaaataaatctcagctgggaggggtgatacaagcctatattcagctacctgagagactgaggcaggaagatcacttgagccagggttttgaggctgtaatgcactatgatcccaccagggatagccactgcactgcagccggggcaatacagtgagacccccatctctataaaaagaaagaaaataaacatctcagagaaaaaccacctactatgtaatcttgattacaaaatataactagcttttcaaagttggtttgagacctgtcttttcattttctaaatatttatgtggtctttaaagtgatgtagagtctgtgagaggcactcagttactgatggtataagttcaaaaaaatctggcttgacctctttcaaactctgtttccctatttatataatggagctaatactacctgtcacaaaggattgttatgaagaccatatgagataacaaatattctttcagttccatttgccacttctgacaaagagaaggttttgaaaagtgagctcaaatgtacctgttaccaagatggcctatgtagcaccaccagggggagcagagaatgagagtttcaaccagaaaacagttggtttctgaaaacttattcagagacactggtaatataattcctttctattttctaaacatttttctagtctattacatactcctatttacatgaaataagagggattggtatatcggctatctactgctacgattgagggaagagagagaccctctcatattgttttatatttttttatactcagtacctgttttaagaaaaaacaacaaggaagtaaaagcaaagacaggcaacccagcaccaggcccgaaaccaggactgggcctgcctggccaaaacccagtagttaaaaatcaactcataacttagaaagcgatgttattcatagattccagacattgtatagaagaacattgtgaaactccctgccctgttttgtttctctctgaccactggtgcatgcagcctctgtcacgtaccgcctgcttgctcaaatcaatcacgaccctttcatgtgaaatctgtagtgttgtgagccctttaaaaggacagaaattgtgcattcggggagctcggattttaaggcggtagattgccgatgctcccagctgaataaagcccttccttctataactcggtgtctgagaggttttgtctgcggctcgtcctgctacacaataatgtgtaacaaactgccacaaaagctgaagggacatataacaataaacatttatttctcaatgtcagtggggtccagctggtctaaggtgagctttgctggaattgggcatgtgtttgcagctcagctggctcactcctatgtctttgcatgagctctcctctacatgtctcctggtcctctttctgccatcaacaggctagcctgggcatgtccttatggtgatggcagagggcaagagtacctaaggcccaatctttccagtgtctttcaatcctctgcttatatcaggcttaccaatgtctgttggctcaaagcaagctacatggacaaaccagagccagaatgggagaacgttcaaagctacatggtaaagggccaggatatggggctgggaaattacctgggcattattgcaatccacctcaaaatgtcatcaaggctctccacctgctgctggaaccagttcgtgtgaggagaggaagatggtagcatctttccaaacaataaagaccaagaaccttggcagtcttcatcctactctagcatttgacactgttgaccaccttgtcctgaaaatgtctctcctcttggttttcccatttcaagaatgtgttagtcttctatcaatatttctggatgccctttcctttgtaaattattttttctgccaattccctaaacattgacattcccttcatacctaccatctcactgtctcctctctttcttactcctttcacctattcccaaggcctcagctacacctgtatgtaggctagaaactggagccctcccaactctcatgaaagtcagacctatatttctaactatttgtttgtatctttatgggctgtctcctaggcccctcaaattcatgtcaaaaattgagctcccagttgcgaacggcaatccacacctacttccgtatactctgtttcagggcatttgccacattgtatatacttgcctgtttacacttctatttctctactctttaactgtgaactcatggaaggcagagatgtgccatgatcattttttgcatctccattgatttttataatgtcaagttcatgtggataatattttgaaacattagctattactattattattattatttgtctaatggtgtccaactttagtgacagaggcagggaaatctcagctatgtgttcaagtaagtggattattggtgactcatttctctaattaagctacaccagggtctcagcaaactttttattcaagggccaaatggtaaacattttaggctttgcagaacataagatttctgtctcaactactcaactctgtgtttgtagcgtgaaagcagtcacagacaattatgtaaatgaatgggcatagtctgttccaattaaaatttcatttttggacactgaaatttgaatttcacataatttccatacatcatgaaatagtctttttttaaaaaaaatttctttcaaccatttaaaagtgagaaaaccattcttaacttaggctgcacaaaaccaagtatttattcttttcttgaaagggctgatagaacagcatacagatagcaaagacaaatccttggcttcggcatttccaagtctgaaggttggtataagacagaaaatgtggaaaaatgtatgattagtcacaaataagtttccccatcaccaccccatttccctcctctaccaaacactagataaaaattacttgggcagaaaggggaggaggttgtagggtaaagggagaaaccaagggtttagacactggtgggttaccaaggaccctctcatccagtgccatgccccatactgatagttggggaaggtaggaattatagaactctaactaggttggagattttttcttccctccacccaaggatgttcccaggaacttatatttaacataagaaaagagagatctcaaactgaagaatattacgtttcaatgacccctaaccttcagagttgaggctctaagtagaaatggacttacttcaaaatttcttgcactcttgaaattatactatttacagaggcactcaattaagtccagctctttcaatgttcattttagcctccaaagatatcatcctgaggtatcatgttgtacttgcagggccctaagcagccacctggtttgcctcatggtttaaacaactgataacagttccataacgttcttcttactattttggaattctggctgtactttacggtatttctttcctttaagaggacttatctataaatgtaatggcagcaaacatattggagactaacaacttccttacaagagacactaatatgaagcagagtgcatttgagagtcaaatctttggcacagtaagtaaaatttctctagatcccaggagacctcagacactctccagttatattaacattgcagaaaatttccagggccatgaatagagacatggcttatggaaactctgaaagatatctttcatgcagagtttgaaaaatatcattcagagtttccataagccatgtctcaatagacaaaactattctagggcagatgacatcccccaaacaaatattttcatgaattttacattttcagtgcattgcaagttttaaggattaatgttaaggttgggttttaaatggaagcatccctgaatgaggttgatacctcattcttttttttttttaatctcaatcgttgtaactttctctttcatgagtatctgataactgctttcacctagttgttgcataaatgcatttctagacatattgacatattttatgtctgcctttcaatcatgcttcactttttccagtaaatcagttactagaacatactgaagatgctgtacaaatgccttggtttctttctgccaactgaaacagcttgtttggggctcatttttcattacgttttatagcagggtgtagtgctccagggaaaaaaggatttttgtgtttatccctcagctattttctttatcctccattggatttctcagttcaactttcttaatattttaatttttctctgacacatacacatatatatatatatacatacatatacatatatacatatatacacatatatgcatatgtgtgtgtgtgtgtgtgtgtgtgtgtgtgtgtatatatatatatatgtatgtattattgggccttgtagaatctgcaataacctgcaatgaggaccaacttacagcttagcttataggtatttttttctaaaagtcaccattagcgagtaaaattatttcatcattcaggaagaattattgatctaaatatccagctgcaggggagaggggaattcagacaattgctatcagctaccatttctccaccccattaaaagagtatattccaaaattaagaatatattccaaaattaagaatatattccaaaattaaggctgggtatggtggctcactcctgtaatctcaacactttgggaggccaaggcagagagatgacttgtgcccaggagaccagcctgggcaatataatgagaacttatctctacagaaaaatttaaaaattatccaatcatggtagtgcatgcctgtagtcccagctacttgggaggctgaggcaggaggatcacttcagcccaggaggaggtggaggttgcagtgagctgtgatcgagccactgcactccacagtccagcctgggcaacagagtgggaccctatctagaaaaaaaataaaataaaaaatatatatatacacacacacacatataaataaataaatatatatacacacataaataaatatatatacacatatatataatatcacatttggactttctggagatttgagacagttgtcaaacataaagcagtatgggctgggcacggtggctcacacctgtaatcccagcactttgggaggccaaggtgggcggatcacttgaggtcaaaaattcaagaccagcctggccaacatgatgataccccatctttactaaaaatacaaaaaagtagccaggtgttgtagtgcatgactgtaatcccagttacttgggaggctgaggcagaagaatcgcttgaacccgggaggcggaggttgcagtgaactgagatcgagccaccgcactccagcctgggcaatagagcgagactccatctcaaaaaaagcagtgtgtgtttcagttttaatgtatttcagagacagtatttgattatgtacggccacgttttatataaagaacactttgttttcctagagtctagaagacagcttggaacataataggtgttccatacatttctgctaaataaaatagttgttttaaaagcacaccacattttattattgttacccatccattttaggttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacaggtgagtgtacttatatattttattctgttgggcttttctttatatatcttttctgctgagcacagtggctcacacctataattccagcactttgagaggccaaggcaggaagattgcttgagcctaggagtttgagactggcctgggcaacatagtgagaccctagtctgtacagaaaaataataattattattagcctgggtggtagaatgcatttgtagtcgcagctacttgggaagctgaggtagtaggattgcgtgagcccgggagtttgatgctgcagtgagctatgatcatcccactgctctctagcctggaggaaagaccaagaccctgtttcctaaaaagtttaaaacagccaggtgcagtggcttatgtctgtaatcccagcactttgggaggccaaggtgggtggattaccttaggtcaggacttcaagacctcctcggccgacatggtgaaaccctgtctctactaaaaatacgaaaattagctgggcatggtggcaggtgcctgtaatctcagctactcggaaggctgaggcaggaaaattgcttgaacccaagaagtggaggttgcagtgaactgagattgtaccaccgcactccagcctggccaagagagagagacttggtctcaaaaaaaaataaaaataaaaataataataataaataagttaaaaacaaaataaagctacaagatattttttttctctttacctttgaccaaaattgacaaaactattctagggcagatgataacatttaaattgtcattttgctttgattttcttaaggcttactacaatttatataatggttctcaaacattcctgggtataaaaaccatctgggaggctgggtacgctggtttacacctgtaatcccagcactttgggagaccaaggcagaaagattgcttgagcccaggagttcaagaccagactggacaagatagggagaccccatctctaccaaaaatacaaataaaattacccaggcatggtggcccacgcccatagtcccagctacttggggactacaggaagaattattgatctaaacaggcttcaatcatagctcactgaagcctctgcctcctgggctcaagcaatcctcctgcctcagcctcccaagtggctcagactacagatgcggtccaccatgctagctgaggcaggaggatcacttgaacctgggaggtcgagaatgcagtgagccacgttcatgccactgaactctagcctgggtgacatcctgggcaattgtgagccatacaataagctaagaacttgttttgaaaaatattatctgggtgtggtggctcaagcctgtaatcccagcactttcagaggcggaggcagttggatcacttgagcccaggagcttgagaccagcctggccaacgtggcaaaatcccatctctactgaaaatacaaaaattagctgggcatggcggtacatgcctgtaatcccagctattcaggagtctgaggcaggaaaatggcttgaacccaggagacagaggttggagtgagccgagatcgcgccactgcactccagcctgggtgacagagtgagactccatctcagaaaattttattaagaacatattctcctaaaagagacacaaaacaatcatatcaataaacgttatctactatatgtaaagcaatcagaaagttaaaactcctaaacacagaattctcttctcctcaacaggatttagctgatttattgtttatctttagatattttcctgcttctaatattattagtttaattttatattcatttattcatgccattcaataacatcttagccaaatagacttcagttgaagcacataataaaatgaatctattgtaattgtaataatactcctaatggccccattaacctaaagatgtctccctactgtaggtaccttatacactagatttaacattttcttttcagaactgaaggactttattataatcccagtatgaatagcatcattattataacattctggaattgtgttttatgttttcaaggcactttgacatacattataaatattgatggctgccaaattagtagagggagcaaagagcatgacttgctgcaaagctcttctggtatctcctactgcccaaatcttagaaatactttggccaggtgcagtggctcatgcctgtaatcccagcacattgggaaatggaggcaggtggattgcttgagcctaggagttcaaacccagcctgggcaatatagtgagactctgcttctatttaaaaaaaataaaaataaatagaaattaaatttaaaaatgttaaaatgaagaaacaacttattagggaatccttttctctttctttctttctttcttttttttttttttttttttttttttttgacagtcttgctctcttgctcttttgcccagcctgaggtacagtggtgtgatctcggctcactgcaacctccacctcctgggttcaagagattcttgtgcctcagcctaccgagtagctgggattacaggcacccaccactatgcctggctaatttttgtatttttaatagaggcggggtttcaccatggtgggcaggctggtctcgaactcacgacctcaggtgatccgcccgctttggcctcccaaagtgctgggattacaggcgtgagccatggcacccagccagggaattattttcagtatcagttctcttttttaaaagttagtttttaattgaaggtattctgtcaagttgatactgttaacaattcgtggactttagatgccattttataatagtcagaatttagttgataacccttttttttaatgaactctataactgcctagcaagattatgcaaattgataactaccatttatcatttacgaagtactcctgtgtataagcttgtttgattatgatgtcagccatatttggtagtgtaattagcgctactttacaaaagcggaaactgggcatgacttactaaatagtacattgctggtgggtaatgacacctaaactataacaaaacttttcttattcaaaatattgaactgcttggctaggtcagttggtagagtatgagacttttaatcccagtgtgaaaatactgtgcattttccccaccatccctcagcaatttcattctttaatttcagggaagcagaggagcaacttacttaagtattctaagtataggactacaaatgttcttctttaaacataaaagtcttggcgaggtgtggtggctcatgcctgtaaccccagcactttaagaggccaaggcgagtggatcacctaaggtcaggagtttaagaccaccctggccaacatggtgaaaccccgtctctactaaaaatacaaaaattaactgggtgtggtggcaggtgcctgtaatcccagctactagggaggctgaggcaggagaatctcttgaacttgagaggcggaggttgcagtgagccaagatcctgccactgcactccagcctgggtgacagagcgagactctgtctctaaataaataaataaataaagtaaaataaagataaaagtcttaagcttcaggtagaaggaaataggaacaccacagtttaaatttaaggtctgtttcctgaggagaaaaatcacttaagagacaaaaataccaattaaaattaagtatccctgaaaacttggatttattaaagtttaacatgttagctaagagaaaccatagactgttctcttggtacaaattcccttctaagacacattacatgagaaacagtaaaagtgtgttagggaaagtgctcatgttaaatctctttgaaaatgtacctttttttctgtgtgtaaaagcaatgtaagtttactgtagtatgcaacctaaaaacatccactatttacatttatttaatttaatactagtttttcctatgcatttttttaatgtttggggctatgatgtatatactattttatatcctgattttcttacttaatctaccctgttaagtttttaaaaactgatttcatggctgcacggcattctcgtttatgtatgtactataatttatttaggcatttccctacctaaataacatctaggtcatttccattttatccattatcaataaacttctttgcatagctttgtatataaatggtctttattcctttagttctaaagaagaattattgcatcaagagttaagcaccttttaagatgctgatgtatgttgtcgaactgctttttaccgaatctttaatattgattgctttttaaaaagggacctatgaaaagacagtcattcacaaaatactcatttagcctctaccatgtgccaggcatttttagatccttgcagaacctcagtgagcaaaggagacaaaattccctgccttggacaagtttccttctggagaagacacacagtaaaaatcaagcataataattacataaattacattgcatcatacataaagatgtaaataaaagcagtaagaatcagacttcacagctgaagtatgaattgcctcacaaatgaaaaaataaaatgatatcatttctgtaattatttatttaaccaacttgtttgataatgaggttttttggccagccaaacttttccagtgcttaaaggtttatttatgaagaaacacagcccaggcagtaatgcctcttccaagcaggacttttctgaattagtctctaagattctgacatgtgtattactgaattgattcatctcaatacaatgtgtttgcaaaattctgcccagctaagaccagaggacaaatcctgaagtgggtatggcttgtcctgcagcctcggcattcttattcttttctgttgctttccctctgaatagtgcctggcttggccattaaaaacctggtctcaaaaatgaaccaaaccaactcacttataatcaactttaatgacttattctctttttcttacttagagtatttagactttaataggacaaacaaagccttatactgaaaaagaaaatcaatcctccagaatacccatttattctatctgatataatagcaagaggccaattaacagactgaatcccagggtgacttcaggataataaataataatagctaacatttattggatgcttactaagtgttgggcattttgataagcattttacatatgaattgttctttatttatcactgcagctctataaaaggagtgtaattattatcccagttgcacagatgaaaccatatggcccaagcagttttgtcaaacattacaaggctggtaaacagtagagccagggtctaactcaggctatgggattccagcacccatgttatttatagctctgctagtctccttcctaagagacctaggagggtcctgcatccgcctgtgaaacaaaatcattctctacacattagctagtaataaaactatgccaacagagcttcatttctaatgcagtgtttgttatggaaatgcaaacgcatgagaaaagaaccagaagatactactgactactgctactttggcttgaatacaagatgtggaagcagatttgcagtagatgatgagaatgaaaccatagtactataggaggtttctgataggataggtaaggaaggggcagtctgagatgaggataaaggataggtaaaaaaggcagccttagccaagacaggaccatcatgggcaattcatcatgtgctttaccagctaattatgggctatctagaaagcactgtttctcatagtagggtctgtggacaatctacattaagaatgcttgggcactttttttttttttgatacagtctcgctctgtcacccaggctagagtgtagtgcaccatctcagatcactgcaacctccgcctcctggttcaaacaattctcctgcctcagcctctcaagtagctgggactacagacatccaccacacctggctatttttttttgcatttttagtagagacagggtttcgtcatgttggccaggctggtctcgaactcctgacctcaaatgatccccctgccttggcctcccagagtgctgggattacaagcacgagccactgtgcctggcctgaatgcttgggcacttcttaaagtacagattcctgagccctttgccaagcgatacttctgcagtgaagcataaaatccattgctgtagaggtcagacacactctttaagagaaggaagtgtcatcataaaagacaacatagggaatggacagaaaatgtggacagaaaggcagagtggatatgattgcccaagccattgaaacgggagagttccctgactcctgtcgcatatcatgtggctcatctattctgccaaggcacatgctcaaacccgttacaggagggggagcacacagatggacaggtgcgcaggagctggggtgagcaccttggggctccagccccacagtagcatctaggggtggatgcctgtgactcccaaagcccaagtgggaatgtgatacagttcactattttagctttgctgtctgcagacagcttaactgttaaccagctcagtgccctcttggtacccaggtccttgtccagtgtccaggaagaatcaggtcacacacagatttgaaggatgaatgtgggggttttattgagtggtggaggtggctcttagcgggatagatagggagctggaagggggatagagtgggaggatgatcttcccctggagttggctgtccagcggccgatctcctctctgatcgtccccaggggaacttctctcagcattcagatgctccttttcttctgtccttctctgccgagccattctgccattcttctgctcttctatttatctctctgtctgcttctggaacctggggtctggagtttatgagggtacaggatagcggggcatagcaggccaaaaggcaacttttgagcacgaaaacaagaatgcctgcttctatttagggctatgggtttccaagcttgagggtgggacctctgccagggaaccaccctcatttattcagtattttcctgtttgctgtttgtatcaccatcgccttagtagtagtggtttgggtgacagaaaagggtgggcatgtgagaatcttaggccattatctctagtactatctggtcacctctctgtttcctatttctcctgagtcactgaccaccccagcccacctgggcattacaggaaccccccaaagcacaggatataggactgttgtcgtaattaaccatcacatcacacatgaccctcttctgcctagaactcaccctgtctctggatgtgaggtttcagctgagattatgagaaccgctgagagctgctgaagttagagcttctgatccaccaaccttgataggcactgttatcctggggtctttcagcagtgcggaaagagccccaaaggggaaaagacaatttgtcattgtagaaaaccaacactgaaaatgtataagtcagtagtctaaatttgctactactgacttaaaaaagctgaaacaacaatggctagccaggaatctttttcaattctgcattgtaatatagatccctttttaacgaagaaaagacacaggttctataattcctttaataacaggttaaaggcttaagggaagggcagtcacatttcatgatgactaattcacttgcttgaattgctgcttgccatagaaaagtttcccagagaactcatattactctttttttttttttgacagttttccagaggaaggcaagtatgagcaagatattaaacaacattttgctttcctctcacaaaacagtattggttgttgcactaccagtgactccttgaagatgctcattaatttttcaggtttttaagtggctaaaagggaaaaagcaaatattatgttaacggaactaaatatcagtgctattaaatataatgcaaattagatgatggcacacagaatgtatttttcaaacattttattatgtgtaattagagatttgtgaattgtccacatagagatgggttctgaacttgtagactctattggttactaacccatgttaaacagacacggtgtttcttgaaattctaatcactttagacttttcatttgggtttaactttcttcaggtcctgcctctgataaaccaccaagtttctgcagaataggaaacaattcagaagagttccataatctccctgaagtttgcaacctattactacagaacaaagatctttctttctttctttctttctttctttctttctttctttctttctttctttctttctttctttctttctttctttcttcctttctttcttttctttctttctctttctttctttctttctctgtctctctctttctttcttttctttctttctttctttctttctctctctttctttctttctttccttctttctttctgtctttctttttccttccttccttccttccttccttccttccttccttccttccttcctcccttcttttttagacagggtctctctctgtcacccaggctggagtgcagtggtgtgatctcagctcataagatctgggctcaaacaatcctctcaccttggcctttcaagtacctggaactacaggcatgcaccaccatacccagctaattttttttcttcctttttttttttttttgtagagacagggtttcaccatgtttgccaagttggtcttgaactcctggactcaagaactctgcccaccttggcctcccaaagtgctgggcttacaggcaggagccaccatgcctggcctatgattatgctttttcttgaagtcatcatcttctatattagtttcctattactactgtcacaaatcatcacaaacttgaaagcttaaaacaacatgaatttattatcttatagttctggaggtgagaaatccaaaatcacaaccactgggctgaaatcagggtgtcaatagggttatgttccttctggaggctacaggacagaatcagtttcattgctttttctatattctagaggctgcctacattcctcagctcatggctccatccttcattttcaaagccagaagcatagcatcttccaatctctttctctgactctcaaccttctcccttctgcttataagaactcttgtgattttaccagatccacccatgtaatctaggatagccacttcctctcaattcccttttgccttataaggtaactgagtagaaagaacatactcaatttctcttgctatatagtactttcacaacacaggtcacttctgtgacctctgattaccaacatgtgtatggggatttctccccctcagcaacaaattatctggcagattctttgagggacaccagctgtgtgtcctccaagtcaattcattctggcactatctgcctagacatagtgtcagatcctacaactcccacctcagatgccagtctcaagtaataggtggttacctatacttccatctgattggctataaattagagtttgtttcctgatctttttttcagatttgatcaatttgctaggatgccccacagaacttgggaaaacacttatgattactggtttatgataaacagcattacaaaggatacagtcgaacagccagatggaagagatgcagtgggcaaggcatgtggggaggggcatggagcttccataagctttccaggtgcatcacctgccaggaacctccatgtgttcagctatcctgaagctcctagaacttaggcctttggggttttttgtaggcttcattacataagcatgattgattaaaccattggccattggtgatcaacttaatcttcatcccctctcccctctgggaggttggggatgggttgaaaaatcccaaccttctaatcgtgccttgatctttcctctgaacaacccccatcctgaaactacataggggcggccagccactagtcagctcgttagcatacaaaatgaccgttaccactttgggcattctaaggattttaggacttgtatgccagaaaaccaggatgaagacacaatatgtacttcgtaatattatagtaacctgttcacagattccagggattaggacacggacatctttatgatgccattatttgtcctactacatctccctacctccccaaccactaccaccaattgcagtttttactagtcaggatgattaggtgtaagcaaaataaatcaaggctggttatcttaagcagaaagagaattattagaaaggtagctgaaaatcagtagaaagcctggcaaaatgggcatgaacaggatccgagtgagagcaggacccagaaccacagccaaaatcacagcctaggaaaagtctggcgaggaccctgcagctgacgctgatcactgccactgcctgccctggtgccactgtcactgtaccctggatacagctatggtgcccacattggattctaagtggtttctggaagccctatgtcaacccttcaacattcacagcctgggtgttaggggagggggcatctggttggtgaggtttaggccatttgcttgtagccctactgcctctcagcttttttaggatgcccacaaagaagtatatcctagtgctgggcaaataaaacatggcaaatgtctgctagactatacagattggaagatgctatgcctggagagcaagggtgtacttctgaggaatctgttggccactgtgtagacttggaagctgtccattctttcatatagagttttgctacactttgacatcagaccttctctgtatggtccttgtcatttaggaaaatttcctgggtggctactgctttttgccttttcctcctcttattctttctttttaacaatgtaactgccatatgtagatttcttaccttctccctacataccaagtacctaaagcccaggaatataagaaggaagataaacccttgaatatgtctgtgtgtaccctgctacccttatatacaccgctgatactataatccactaaatgattcattgcttgacttgtttttcaaggtgtggtaatgagtttgttctgacacaccgttttccctgccctgggcttctggtgcctatttgatatgttggcattagttttgccttgctaattgacatactcaactctttacccttggcccgataatgttgaattctgaccacagagctaaactggcctggcttggagaaatggcacttaagtgctgtgaaacagctgaattattaaaaggagatgcgaaagagagaaaccaaaaggaggtatttgtgttttgagaaaaataggagggagggtgggggcgaatctccaatgatttaaaaaaaaacacatcctttgtctcctttaatatgactcctctttcttgaatatctagaacccctgaaaggtccagaaaagtccatgtgtctgctctaatcaaagcctttatgatgcaggccttggttactgtggctttgacatcaagattggcaagcgcaaaagtaaataaagaaaccttagagatgtctataccctttggctcagtaattcctcttgtagagatctggccttaagaaataatcagtggaaggaaatttatgtacaatgatatacatccaaaacctaattataatagtaagaatttggaaccagtctaaaagttcaacaatagcaataattagtgcttattaaggttttatttgtgtaaaacatggtactaagtgcttgatatgaactgtctcatcaaacctcatgacctcactgcttttatctaattttacaaatgaagaaactgagtcactgaggggttaagcaatttgcccagggccatggaactccatctagtagagccaggacttggactgagtttcgtttgagtctgcagttggtgtttgaaaccacctagctatacagtttctcaataggggtaagattgaataaatacagtaaaacatgatgaaacattaactagccatagcatgatgttttgaacaatttttaataaaatgaggaaatttttattaagtaatattgaataaggctgggtgtggtggctcacacctgtaattctagcactttgggaggctgaggcaggcagatcacctgaggtcaggagtttcagaccagcctagccaacacagcaagacctcatctctactaaaagtacaaaaattagctgggcgtggtagtgtgcacctgtaattccagctactcaggaggctgaggctggaggatagcttgagcccagggggcagaggttacagtgagccaagatcacaccactgcactctagcttgggtgatggtgtgagactctgtctcaaaagaaaaaaattgaataaaaaaggcaagacaaaacatttataaagagtatgatctccactaggctaccaacatacacaaaagactgttaacattttttttaaataatagtttctagtttgcaaacaaatataaaattgtattatcttctccatacccttctatacttttcaagcatcctgtaattagcatgtattacttgtgtaataaaggaaagtagtcggttttaagaagaaaataactctacgctagaagatttaaagcatcagtgctaaatgggttagcacagtagggcttgtggggtccagagccccacaaggccaggcagccccaacacaccatggcgagtcctcagtggagcaatgctaagtctcatcctgggagaggctgcttgcagggctgactctgcctcccaccctgagccatcctgctgtggaagtgaggttattaatttaatgagatcagtgaccagcacaaactacatgtcagaactggatgggaatttccactcttcaccctctacctaggtgactttgagcaagttatttatcctttctactcttttgtttccttatccgtataatgaggataataatattgtctgtgtgattgggttgttgtgaggattaaatgagagaaaacatgtaaagtttagcatgttacctgtgacataattaatactcattaaatggtcactttaaaaggatgacaaaacacactttgccccatggttgatgatatggtttggctgtgtctccacccaaatctcatcttgaattgtagttcccataatccccatgagtcgcgggaggtaattgaatggtgggggcagttgcagtcatgctgttcttgtgatagtaagttctcatgagatatgatggttttataaggggcttttccccctttgcttggcacttatctggcctgttgtcatgtaagacatgcctgtttccccgatcaccatgattataagtttcctgaggcctccccagacatgtggaactgtgagtcaattaaaattctcttctttataaatttcccagttttgtccaggtgcggtgcctcacacctgtaatcccagcattttgggaggctgaagcaggtggatcacctgaggtcaggagttcgagaccagtctgaccaatatggtgaaatcctgtctctactaaaaattccaaaaaaaaaaaaaaaaaaaaaaaagccacgcgtggtggcatgctcctgtaatcccagctacttgggaggttgagacaggagaattgctagaacccaggaggcagaagttgcagtgagccaggatcatgccactgcactccagcctgggcaacagagggagattctgtcttaaaaaaaaaaatccggttttgattatgtcttcatagcagtgtgaaaacagactagtacggttgatgtagaaagaagagctgaggtgatgatttggcatcatccttaaaatacagatggaatacgttattgctaaaaccaggtccttttgagtggatttgattaaactagcctggtgttttggtaggccaaaaaatatagttgttatgctttaaattttgtccaacaataagaaaccatatttctcgtttgagatcactctaaattcccacaggcacattgtcttcttgtaagactaaagtttggtgccagtgtgtacaagttatataaaaattcttcccaaattaaagataatttggattttttttagtatattcaagtatgtcctgtgagattaataggcataagttaatattctgttgcaaggatggaactgtctcattatggacgtaacaccacaaacaccaaatacagtaagatatcatgaggttttttttttttttagcaaattaggcaatgcactgatgacagaactgatataaaaaacagtttccagtcataaaggctgtgtgtgtgtgtgtgtgtgtgtgtgtgtgtgtgtgtgtgtgtgagattctgtgtttgctaatgcttttgtatgttaaaatacttgcaaataccataaagcactaatagcaggtggattaaaaggatgggattagggatggttctttttttctccttttaatttctcctgttgaaaatttttctgtactttaattatcgcttttacagtcaaagatgttaagtataatttaaaaagaaatgacgtagccacgtggtggcagtattccatgaagaatgtaatctacatagctttgtttcagtcctatgtctaacattggcttgatttcttctctgacaattttgtttataaattgtcttattttagataactgattccttgtgaaatttccctatgaggattaagcacctcttataagtgactttaatttaatgcacctgtttgatttggaactatgataacaaatagactctaaaggaagattgtatttattccctgttagggctaataaaaccctagtcagatatgaaaattgtttttatatgatgcaaattaataactgaatgaagtttcattgccaataactacctgtagtttatacaacagaattacattaacctgtattaaaagccaacaacaccatatattacttttaaattaaaaatgctaattttaaaataataaaagtgaaaacaaaaatactacagcagcatatgctataagcccatgattttgctaaattgaaaattgtgttaccttttaatgtagtatttttactcttttttttttttttttttgagatggagtcttgttctgttgcccaggctggagtgcagtggtgtgatctcagctcactgcagcctctgcctcctgggttcaagtgattctcctgcctcagcctcccgagtagctgggactataggcacctgccaccatgcctggctaatttttgtatttttagtagagatggggtttcaccatattggccaggctgatcttgaactcctgacaccctcctcagcatcccaaagtgctgggattacaggcatgagccactgcaactggccagtatttttattcttaaaatttcaaaataatggagattcagactcctgcctgagctccctgcaaatgaacattggcctgtaaagatagcactttagatgaataaacctgactgttggccatcagggcataaccttgttccctcagagtttggtggaaccatatacccatggagcaaaagagacttagcgaggcattgagaagccaaaaacaatttctgatttgtcacaattccgggtgaaacattttcctcttgctgtagagaagccaggacaaaaaacacgggaaataacttttggcttttctgatgttttcatcttctaaaatccctcacccactgttctcagaaaactaccctcctcacgcttatgcctgcacccagagcagccttttttcttttttctttttttttttttgtgaaatggagtctccctctgtcacccaggccggagtgctatggcacgatctagactcactgcagcctccacctcccgggttcaagtgattctcctgtctcagcctcccaagtagctggtattacaggcacgcaccaccatacctggctaatttttgtatttttagtagaaacagggtttcaccatgttgcccaggctggtctcaactcctggcctcaagtgatccacctgccttggcttcccaaagtgctgagattacaggcatgagccactgtgtctggccagaccagcctttttcaaaaatttctgaagccccgtagaaaccttttcattggaaatgtaggacacttttctcaaagacagtcacatgggccacactactccttatacaagcctgtgatatctcagcctcaagttgtgatttctccctgcccccaaaagtaatttttttaaaagaaaaatttgagcactgaaatcagagtgacggaatacacagggcttgaagcaatctcagggatccaaggcttagagccatcttcagaaatgtcttctgccagttgggagaattgtgtccttgaagtcacttctgtcagcttttaattatcaggaaggaggagactggcaaggctgcaccaggacccctttgagttcagactgaaagttaggtaccagggttgctcaccccaccctggtcagaatcattcattagcagtttcctgacagcctttataactagaccaggctgccaggaaaagaaaagagcagagagaagtcattggtgacatcccacccaggtgttacaacaccaaagtgcctgctaaccaaaattaggtttcttatgaggagccaggagaaggtgaacagcatcccaaagattgtgcaaaggcaaaagtgacacatcttggggaccctcaaggaaatctgaaccttattgcaccatcaattgcaaggaatcaaatagagattagttatcatgcgttttttctggctcagtaaaataaagctctttggtatttgctgcctagaagcctcatgaaattagtggacacaccttgaagttttacaacctaggtagattatagttgcccttgcagtgtttcctcctttgagatttacccaattaaataaaaagaagaagaaaagacacatactcgaagactattgcttttattccacccttcaagcccattaaagttattggtttactttagtcatctctaaacaagggaagaaactccgttgggaaatttggcaagcagagtgcaaaatgtaagaaactgacactctttccttttggtttaagttccccaggtcacatcaaaagcattccaacatgacacatggaattctgggctaacagttgcttccatctctacagggcaccttacttctggtaagaaaatacaacttaggctttttgagtagtcttttagtaattgcccattttaacccatcatactgaaaaaatcacatcaggtgttaagtttctggacaataagatatgccttatgtcttccataggaaaataatagacaaagtacaaagatctgcttaaaactgaatgtaagaagtggcttaggtggattttgccggcttttgcaatagattgtatacattttttaaaatttttatttattttattttattttttgagacgaagccttgttctgtcacccaggctggagtgcaatggtgcaatctcggctcactgcaacctccgcctcccaggttcaagcgattctgctgcctcagccttctgagtagctgggattacaggcatccgccatcacgcccagctaatttttgcatttttgtagagacgggtttcaccatgttagccagactggtcttgaactcctgacctcaggtgatccacccacctcagcctcccaaagtgctgggattacaggtgtgagccaccgcacctggccacatttttattttaatagctgctagggctcaagacccaaaaacttctttcaaaacaaattacttacctatcttgtgctaggacttgtctagacatcttcttcaatctttaaaacaacccatgagataagtgttacgcatctattttataatgaggaaactgaaacttagagtagttgaggaaacttttcaaggtcatagagctgctaagtgacagactaaaattcaaatccttttctttcaatgtcctggagtctattgtctttcttttatacaaaccagctcccatttcagttgttagcatgactattatcgtattgatgagcttgcctaaacgttttaggcgtaaaaaaattgagatctggttgtacaatgggtgaacataactctaaatagaaatttcgagttgaaaacttttaggcatgactatttcaccattgaccactgacagaccatttatctccttgtgtagaaatcaggcaggaatagtataagaacttttgcaggttgtattgctattctttgcaccttcatttatttaatattcattaagcaactcctgtgtacgaggcactgttctgggtactggggaatcagcagtgaaaacaatgagcaaagcccctgtcttcatggagcttctattctagccagacagggcagaaaaacagcaaacaaaacaagaagaaaagtcaggtggtggtgaagtgtcgtaaagaaacatgaagtgggtaggcatggtggctcacattttgtaatcccagcactttgggaggccaaggcaggcagattgcttgagtccaggagtttgagaccagcctgcacaacatggcaaaaccccatttttacaaaaaatacaaaaattagatgggtgtggtgtcatgtacctgtagtcccagctacttgggaggctgaggtgggaggatcaactgagcaccagagatagaggctgcagtgagctccactgcattcccgcctgggcaacagagcaagaccctgtctcaggaaaaaaaaaaaaaagaggaaaaagaagaaaaagaaaaagaaacatgaagaaaggtaagggcactctgaattatcaatcaattgcaagccaagtgcttaggttcagtacagttccctaattatagatgcctacacagacctacctacaccttgatatttctgtgggatcagtggaggttaggaactcatggcagctctgttagataagtattattatctctattttccaaaagagaaaacctgagactcagcaagttcataattatgccccaaggtcacagagctgataagaggcagagtttaattcaaacccaggtatatcaggccacgctcttggtcattctgctctactgcttagacccctttgccgagcactgtgttgacctgagggctgtctatcctcttccaggcactaattaatgcccaagggtgtgtggcagccagtacccccaattagttgcttcaaatagtcagaaatagctctttagccctgggaaaacattaatttcatatcccatcaagattttgcagtgagctagagttactcagactcctgcctgctgattggctttagaagagggctgggcagcctggagaccccggtatgtgaaataactagggtggggcaaacacagtgtctgccacatggtaagtacccaataaacatttgctgaaggaagggagggagtgaggaaggaggatggaagggaagccaatacccaacatggctctagaacaaattccaatgtgataagtaatgcctcaactatcttctatatttgaaaatagggctttttcatgtaccagggagaaagcatgatgagcctggtgggtaatatgtgttgaataaattatattaattatttaaatattttaggagattaactcaactttgacatgcaagaaaagcattggttttgtttgtttgtttgtttgtttttgagacacagtctggctctgtcgcccaggctggagtgcagcggcacgacctcagctcactgcaacctccacctcccaggctcaagccatcttcctaccttggcctcccaagtagcggggactacaggcacatgccaccacacccggctaatttttgtaatttttgtagagatggagttctcactttgttgcccaggttggtctcaaacttctgagctcaagtgatcctcccacctcggcctctcaaagtgctgggattataggcgtgagtcactgtgcccagccagcattgttttttaactaagtgtgagtgcagcataaaggcaattttgatttcttttttattttttatttttatcttaacttgccagtgtatgatttctttcttatcacgtatattgctctaagtaaagtggatgtcctttctcagcaggaaaaatttcatgagcaatagattttgaagaatgatgacaaattgcacacattctatctcacacaaaaagttaaaaaaaatcagtatgattgtaaccagctttagacattgttacagcaattgggaattctcacctgtgtcagacaagccaaatgaagctcaccactaagaatttatacgaaatttgcatgcacaagccgaccacatttgccagagatgcacttctaaaaacccactgacatcagatacatgtagcccaactttctcaaacaaaaagttgtttcctggggtagttgtgcactctggaaaaacagtcactctgtggcctaaagtaaaggttaattttgcttccccccaccctttctcctttgagacctttgctttgagcagagtaaagagaatagtaattctggtatcaaatgaagactaatgcttggttaaaattatttttctttcctttcattagacaacagaggagacattggacttttattgggaatgatcgtctttgctgttatgttgtcaattctttctttgattgggatatttaacagatcattccgaactgggtaggtttttgcagaatttctgttttctgatttagactacatgtatatgtatcaccaaaatttagtcatttcagttgtttactagaaaaatctgttaacatttttattcagataaaggaaaataaaaagaacaatgtttaataagtacttacccatgccaaactctctacaaatgtctttcctttaatcctcaaaatgaccctgccagaaaagcttcctggcctattttacaggtgacttaaatgaggcttaaagaggctaagtcctcagcccagaatcactgaacagtaagccctgagtccaaacacagctgatatcaaagcccatttctctcctttactacacggcgttttccattgtgcctcaaatttacctacagtgcctagattcttgagagtggtgaagtcacaaattgccttgtgttaaaagaaaaacttcagccaaattaaatttaaaggagtttaattgagcaatgaatgtgcgaattgggcagcccccagaattacagcagattcagaaagactccagggttgccttgtggtcagagcaaatgtatagacaaaaaaaaaagtgacacatagaaattggcagtgaggtacagaaacagctggataggttatggattggcatttgccttatttgaacacagtttgaacacttagcagtctatgagtggttggagtatggctgctgggattggccaagactcagctattgttacgggcacatactactaagttaggttttcaatcttgtctgcctattaggctaggttacagttcatccacaaggacttgaatatagaagtatggagtccttctcagatcatatttagtttgctttaataattccccccttttggtgattttctcaattttgagagattgaccaaaactttagtcattgatgtcactatcaccattgtaaatgtacttatatggtctttaaacccactgggaaacagtagaacagtgggttctgtaaggtggcaacaaggactgagtagaaggtacctccttatgctggaacatcctgtttataggagaaaaacaaaacctggtctgttctaggatctatgtgtttccttaaagtcttagtttgactttgtcacatttagcatgaacaactccattttggtttggtttggtctgttggagtctagtgcatgagctcagtccaaaacaatggcctcccataatttcgttttaaaaaaaaaatccccctttttggtcaggttctcacttaggtgacagtgtgaccaaaacctagggcctcagtgccactctcagttaccatcattttgggtttctgttctcagcatgtaattcataggttatggtgtcctgatggtcacacatttcttttagctcttgttattccagttgaagagagaccatttgacattctggagatggctgcttgtaaacatttaaaacctttgagagaatacagcataccagggagattactattaggactattgggagaataatactaagagtttgggttatgttccttacccagggtcctcataaaccaaaccaaaccatctaaaaatcaaatagatcaaagaatgagctacatgaagagtctactcacttaagtgatttttttcattaatcccctacaactgaatcactataatacccgatgttttctccatacatcataagtgccagcagctgtttagccaatacttttcggtttggccaattctattatttcgcataactttcacaagagaatttaaagttttttgtgtaaccataggctttacagtagaatctgctatagaacctatcatgagggatacatttctaatcagtgcctcttttacttcaaactatggaaaaaagacctaacaaatgatgccctgctagaagagtgaaggcctcctggcaatgttctctttagcccatgatgtggcttaagaggaatgaatcaatgttctgtttctgactgactatgaggcaatatatgaacccttaaaatttctcacctgcattgggccttcatcttttatccatcaaagtataacattatccatgtataaggctggctgcaaaatccttcacaaataaacatataccccataatacacacataacagacccccttttcacttctattgttcatagaggcataagcaagaaaaaaaatattcaaagttaagagtctcatgatagtagagaagtcttaatccatgattttaggataagctgttcacattaaggacgctgtcttcttgggagaagctgtcctggttagctttaccttaagggttccgatgggtgtggagggaccctcctcagttgtgagattatgaaagttgtgggatctctgaaaccaaaagttcaaggtcccaaagttttgctgtagtgtggatggcaaggacagtctttctctaatgttctcagaagattcattctttgggttctagattgtgaaggggttgattgtcctcagtgaaccataaacagctttttttaactatgtaaaaatgtactgcagcataataatctactattataacatcagtcttcttgcatgggaaagctttcatacaaccagaaaacatgcattgaaagtgacaattgaatgaaatcccttataaatatttaaatgtccaatcaggtagccaaatgtacctgaagctttgattgttttcccaggaatatgggtttgacaagccaaatattgtttataactattttagtagtttataagtcaccacacaaacatatttaatttggatcattttatcttttccattacaagtcgtaaaatgcagaacttttaataatgaaagccttaaggactctggaaggataaggtggctgtcttggttctccacgagtccatgcttaaaaatggacttatgtcctcttgaataccagttgtttctccaatttaggtgcatagcactgataactgatgggttatcataggtaatttggcttagatcatggagtttattcaaattgtatatctaaacaattttagtattggctgatttagcatgcggatttctctttttttttcttatactgtaagttctgggatacatgtgcagaacatgcaggttcgttacataggtatacatgtgccatggtggtttgctgcacccatcaacccgtcatctacattaggaatttctcctaatgctatccctcccccagcctcctaccccttgacaggccccaatgtgtgatgttcccctccttgtgtccgtgtgttctcattgttcagctcccacttatgagtgagaacatgtggtgtttggttttctgttcttgtgttagtttgctgagaatgacggtttccagattcatccatgtccctgcaaaggacatgaactcatccttttttatggctgcatagtattcaatgatgtatgtgtgccacattttctttatccaatctatctttgatgtgcatttgggttggttccaaatctttgctattgtgaacagtgctgcaataaacatacatgtgcatgtgtctttatagtagaatgatttataatcctttgggtatatacccagcaatgggattgctgggtcaaatggtatttctgatcctagatccttgaggaattgccacactgtcttccacaatggttgaactcatttacactcccaccaacagtgtaaaagcattcctatttctccacagccttgccagcgtctcttgtttcctgactttttaatgatctccattctaactggcatgagatggtatctcattgtggttttgatttgcatttctctaatgactagtgatgacgagctttttttcatatgtttgttggccgcataaatgtcttcttttgagaagtgtctgttcatatccttcacccactttttgatgggttggtttgtttgttttcttgtaaatttgtttaagttccttgtagattctggatattagccctttgtcagatgggtagattgcaaaaattttctcccatactctaggttgcctgttcactttgatgatagtttcttttgctgtgcagaagctctttagtttaattagatcccatttgtcaattttggcttttgttgccattgtttttagtgttttcatcatgaactctttgcccatgcctatgtcctgaatggtattatctaggtattcttctaggttttttatggttattaggtcttatgtttaagtattgaatccatcttgagttaatttttgtataaggtgcaaggaagggatccagtttcagccttatgcatatggctagccagtttcccaacacaatttattaaatagggaatcctttccctattgctcgtttttgtcaggtttgtcaaagatcagatggttgtagatgtgtggtgttatttctgaggtctctgttctgttccattggtctatatatctgttttggtaccagtatcctgctgtttttgttactgtaaccttgtagtatagtttgaagtcagatagcgtgatgcctccaggtttgttctttttgcttagaattgtcttggctatgtgggctcttttttgattccatatgaaatttaaagtagttttttccaattctgtgaagaaagtcaatggtagcttgatggggatagcattgaatctataaattactttgggcaatatggccattttcatgatattgattcttcctacccatgagcatggaatgtttttccatttgtttgtgtcctctcttatttccttgagcagtggtttgtagttctttttgaagaggtctttcacatcccttgtaagttgtattcctagttattttattctctttgtagcaattgtgaatgggagttcactcatgatttggctcactgtttgcctgttattggcgtataggaatgcttctgatttttgcacattaattttgtatcctgagagtttgctgaagttgcttatcagtgtgaggagtttttgggctgagatgatggggttttctaaatatacagtcatgtcatctgcagagacaatttgacatcctcttttcctaattgaataccctttatttctttctcttgcctgattgccctggccagaacttccaatactatgttgaataggagtgcggagagacagcatccttgtcttgtgctggttttcaaagggaatgcttccagtttttgtccattcagtatgatattgtctgtgggtttgtcataaatagttcttattattttgagatacattccatcaatacctagttcattgagagtttttagcatgaagggctgttgaattttgtcaaaggccttttctgcatctattcaggttatcatgtggttttcatcattagttctgtttatgtgatggattacgtttattcatttgcctatgttgaaccagccttgcatcccaggaataaagccagcttgattgtggtggataagctttttgatgtgctgctggattccgtttgccagtattttattgaggattttcacatcgatgtttatcagggatattggcctaaaattttcttttttttgttgtgtctctgccaggttttggtatcagaatgatgctggcctcataaaatgagttagggagtattccctctttttctactgtttggaacagtttcagaaggaatggtaccagctcctctttgtacctctggtagaatgtggctgtgaatccgtctggtcctggactttttttgattggtaggctattaattactgcctcaatttcagaactggtttttggtctattcagggatttcacttcttcctggtttagtgttgggaaggtgtatgtgtccaggaatttatccatttcttctagattttctagtttatttgcacagaggtatttatagtattctctgatgatagtttatatttctgtgggattggtggtgatatctcctttatcattttttattgcatctatttgattcttctctcttttcttctttattagtctggctagcagtctatctattttgttgatcttttcaaaaaaccagctcctggattcattgatttttttgaagagtttttcatgtctctgtctccttcagtgcttctctgatcttagttacttcttgtcttctgctagcttttgaatttgtttgctcttgcttctctaattcttttaattgtgatgttagggtgtcaattttagatctttccagctttgtgatgtgggcatttagtgctataaatttccttctacacactgctataaatgtgtcccagagattctggtacattgtgtgttttttctcattggtttcaaagaacatctttatttctgccttcattttgttatttacccagtagtcactcaggagcagattgttcagtttccatgtagttgtgcagttttgagtgagtttcttaatcctgagttctaatttgatttcactgtggtctgagagacagtttgttatgatttccattcttttgcatttgctgaggagtgttttacttacaattatgtgatcaattttagagtatgtgtgatgtagtcctgagaagaatgtatattctgttgatttggggtggacagttctgtagatgtctataggtcccacttggtccagagctgagttcaagtcctggatatccttgttaattttctgtctcgctgatctgtctaatattgacagtggggtgttaaagtctcccactattattgtgtgggagtctaagtctctttgtaggtctctaagaactgactttataaatctggatgcttctgtattgggtgcatatatatttaggatagttagctcttcttgttgcatttatccttttatcattatgtaatgcccttctttgtctcttttgatctttgttggtttaaagtctgttttatcagagactaggattgcaacccctgcttttttttttctttccattttcttggtaaatcttccttcatccctttattttgtgtgtgtttttgcacatgagatgggtctcctgaatacagcactactgatgggtcttattctttatccaatttgccagtctgtgtcttttaattggggcatttagcccatttactttttttttttttttgagatggagtttcacttttgttgcccagactggagtgcaatggcacgatcttggctccctgcaacctctgcctcccaggtgcaagggattctcctgcctcagcctccctagtagctgggattacaggcatgtgccaccatgcctggctaattttgtatttttagtagagatggagtttctccatgttggtcaggtaggtctcaaactcctgacctcaggtgatccgcccaccttggcctcccaaagtgctgggattacaggcatgagccaccgtgcccagcctagtccatttacatttaaggttaatattgttatctgtgagtttgatcttgtcattatgatgttagctggttattttgcccattagttgatgcggtttcttcatagtgttaatggtctttacaatttggtatgtttttgcagtggctggtactggttcctttccatgtttagtgcttccttcaggagctcttgtaaggcaggcctggtggtgacagaatctctcagcatttgcttgtctggaaaggattttatttctccttcgcttatgaagcttagtttggctggatatgaaattctaggttgaaaattctttcctttaagaatgttgaacattgacccccactgtcttctggcttgtggggtttctgctgagacatctgcttttagtctgatgggcttccctttgtaggtaaccagacctttttctctggctgcccttaacattttttccttcatttcaacgtcggtgtatctgatgagttgtgtcttagggttcctgttctccaggaatatctttgtggtgttctctatatttcctgaatttaaagtttggcctgttttgctaggttggggaagttctcctggataatatcctgaaatgtgttttacaacttggttccattcttcttgtcacttttaggtacaccgttcaaacatagatttggtcttttcacatattcccatatttcttggaggctttgtttgattcttttcattcttttttctctgatcttgtcttcttgctttatttcattgagttaatcttcaatctctggtattctttcttccacttgattgactcagctattgatacttgtgtatgcttcacgaagttcttgtgctgtgtttttcagcaccatcaggtcatttatgttcttctctaccctggttattctagttagcaattcgtctttttttcaaggttcttagcttccttgcattgggttagaacatgctgctttaactcagaggagtttgttattacccaccttctaaagtctacttctgtcaattcatcaaactcattctccatccagttttgttcccttgctggcgaggagttgtgatcctttggaggggaagaggcattctggtttttggaaatttcagcttttttgtgctggtttctcccaatcaagccagtggatcttagcttgctgggctctgtgggggtgggacccactgagccaggcaccggagggaatctcctgatctgctggttgtgaagaccgtggggaaagcacagtatctgggccagagtatactgttcctccccgtacagtctgtcatggcttcttttgactaggaaagggaaatcccccagccccttgtgcttcctgggtgagacgatgccccaccctgcttcagccccccctccatgagctgtacccactatccaaccagtcccaatgggatgaacttggtacctcagatggaaatgcagaaataacccgccttctgcgttgatctctctgggagctgcagaccagacctgttcctattcagccaccttgccagctctccagcatgctgatttttcacgctgatttagcatgaaaatctggcatagtattttcttggtatttaattaatttttgttctactttggttagcagtcttataaaccagttagtctttttattaaagttttagggattcttaccgagtctaaatgatacgaatttaaagttattagaaacctgtattcaagagtgctttttagcatcctttttatcctttcatgaactttctaaaagataccatattctaggattttccgtgtttgtgaagttttcagaaattgcattagcattaagtaattaacttaatgtaatgactttaaacagtgatatttaaaaacacaattcacaaggaaatgtggttatctctgtggtctgtgataaattaacataataaccttaattatgattgaaaggatatactcagacattagaattttagaaatcctatacaattttggaacatatattaatattatttaacctgaagaagattaaacattgtttttattttgacaatcccatgtaactaaacatgtcagataatcctatttacctctcctttggatgctccaagggccctctgtagcatccaaaatttgggggttagaaagacaattttgaagctgaaatttcattttgggaagcctataaaatatgttaaaggtttaaaatacttgatataatgcttaaccagtttgaccatgaggtgaaattcttgtaaacattttgtaaccctttacaaatttttgttaaaaagcagatcagtgctctaagaaaaacatgttgtgcttttatttcaattttaatttatagaaaaacttagcaatacccctttatctttagccaatgtccacacagaatttctttttataagattaacttttcataaaccttccacaatgtattcaagcctttagctttattttaatctaatttaaaacaatattttaaccctctaacctagacaaaaatttacattcctgtgccttcttataaccttttagtaaaaacgcattttagtttcctgacacaccttgcatgtaaatctattttcagtagtctggattacatgttgtaatggtaactgttagcaacttttaattttggtgcctaaatttcctttcatgtatcctttcatgacttatgcagaccatctatgacatgcttagactttctgacttgtcctaatcatccctctttttaagcaaccagttattttactttaggacaagaatttaccatacaactttctttcttatataaaatctattttctttataatcttttttgcatagctaggggagcatggctaattccacatgtccccaggccttattgagaatctaatgcctccaagataggtaaattgaacaattttcaaaagtcaaagcagtttatgacctgaaagcattagtaaacctaatatctgacctgtctaatttagacaaaatgtctttattttaccaataatcgttaaagccatttttatttcccaaagattactaaagttacttgaactaagacattacagtttttattttttcttccaaaagtgttttatctaagcacttatttttctttaagccaattacttagagttcttttatatgaacatcacacacacaacacatatataactacacagagaacaagatccagtagttgtaggatttttcatttgccagtttcttcattggattactgaccttggggtggagcccatcaagaaatggctaggaaaacatgcagtttctggggtctaataagcaggcacagctggaaggcaaaatggatttcgagagagatctatttgcttttaattcttgaggttccatgaggaaaacagagggttttttccaaaacaggatcagtggcaccttctttatttttcccaaggagtcctaggctatcagaagttatcttagggcctctcatgtgtgccttaagagtggcaagacaaaatggagaaaaataattcagtcgactgagaagaaaaaacctttttcagcaaaacaagatccacaaaaaggaaagacataaatgtggccaggcgcagtggctcatgcctgtaattccagcactttgggaggccgagctaggcagatcacgaggtcagcagatcgagaccatcctggctaacacggtgaaaccccgtctctactaaaaatacaacaaattagccaggtgtggtggcaggcacctgtagtcccagctacttgggaggctgaggcaggagaatggtgtgaacccaggaggtggagcttgcagtgagctgagatcatgccactgcactccagcctgggtgacagagcgagactctgtctcaaaaaaaaaaaaaaaggaaaagacataaaggccttttaaatatacctatagcttggatatccacttttaattaagctgactcttaactatagtgctctttaaaaaatccttttaaatctcttgttacccaactttagccatgccaagtggcctgtatttctggcttttgaactttacctcccaggtgctcagagaaaggaaaattcaagacaattcatggaagggaagagaatcagcaaatgataaagttcccacaggtatcaaaccagaaaggactcattccttaacccaggaattgaacccaggccaccactgtgaaagtaaaaaactttagctactgagctacagtactgggtagtctccattgtgcttcccagaagggctctaaagtacttaattttgagcttgcaaaagcttttaactactcaacttaatttttagagctaactgtgacatgaaccctaaaattcctgttcccttgaaggcagagaccaagaaaaagtaccaccacgtggttacaaagtcaagctcccaagaatgtaaaacaagatggagacctcatccagtttttttttaatgcacttcagtgtgttgttgttcatttggaatgttccattgtaagttatctttagtaaaattttgctatttctgtaagactttgctgcctcccaagcctaatgtataaactggaaggaactctgcttttcagaaattaaggatctcatttttacctaaaatattggctttgctttcaggttcccttgatgaacttagccaatgatttttcctacctaagtgtgcaagaaaaatgaaacaaaggtgtagaaaaccaaaaatccctgtgaatttccaaatgccaaattttacaacccctgcaatactaccatttactaccagtttctttctgacctagtcaaatctaagaggcctctaattggatcctagcctgttaattactgatcaaatccaatcctggacccagtccagtttctgttgtgacttctgaacccagtttggaacaggaatttgctcaaagaaacttggagagttcaaaacacaaatctgtggagctctgaaatccaaaagagaacttgccatgatccccagccactctgagagatcaaaggacacaagtaggtccaacaggttccttgcttgttcactcagtgctcctgggggtcgttagaaggtctaattcatatcccgcttctgacaccatctagtaaaagaaaaacttcagccaatttaaaggagtttaattgagcaatgaacaatttgggaatttggcagcagaatcacagcagattcagagaaactctagggatgccttgtggtcagaacaaatttatagacaaaaaaaaaaaaaaagagagaagtgacatacagaaattggcagtgatgtacagaaacagctggttggttacaggttggcatttgtcttatttgaacacagtttgaacatttagcagtctatgagtggttgaagtatggtccactgggattggccaagactcagttactgttacaggcacatactcctaagtcaggttttcactcttgtctgcctgttaagttaggttacagttcatccacagggattcaaatatagaggtatgaagtccttctcaggccatatttagtttgctttaacacttgaattccacccaaacaaatcagcttgaatcagtgtgaagggaagtgtgacaatttttaaatttgtcaattccttaccaattgttttagtgttttagcattcagccccaaagtcccttactcttggcccccttcagttttttccctcctgtgatggtattagtaaagatctatggttagttatttaaaatgagactttgagaaaagcaagacccttggatttctaaattttactgatgcattgagtatttctaagctgctcgatagattagagttgtttggtgtggcagttccccagtgtgtccagttgctcacaaattttgacttgaatgttctttgccgaattggcactgagtttctccttcttgccatcatttgcttcatgaaataatctttctttcgtttacatttataatcaagtgcagtagaaagattttaaatgagctattataaagtctactaatgatttcttatctacataggttttttgctcagaacttaatatttcaaaatttaaattacacattaataaacatattcctaatacccttgtaaggaaggcaaactaatacggaattttatttgaggctgttttaaaatatacttgattatgaagtcccttgaaatattttaatgttcaaattaataccccataaaaaaatcaatatttgtgttattatttaaacatgccctagtgtaaaagtttaagtaacactaagttcataactaagaatagcctaaaaactaattttcagttcataacaaggaattagggcaattctttgctcatttaattatttaaataagtactctttttaaaaagataaaacaagacataattccaatatatttattttacatttgaacagatacttttatttaatacaactattcattatctataaaagccttagttctgaaacagaagtgagcaacagaaagcaaaatattttatttatttatttatttattattattttttgagacagagtctcgctctatcatccatactggagtgcagtggtgcaatctcggctcactgcaacctccatctcctgggttcaagtgattctcatgcctcagcctcccaagtagctaggaatacaggcacacaccaccatttccaactaatttttatatttttggtggagacgggatttcaccatgttggccaggctgctcttgagctcttggcctcaagtgatctgcctgtctttgcctcccaaagtgttgggattacaggtgtgagccaacatgcccggcccaaaacattttaaatataataaaaccaaaagtgggtaaatatatatacatatatatatatatattctcactgtatcagtgtactgtataaaaactttactccaatagcctgaatttactaatttggtctaattttaaatacagaagagagtgtgaattagtaaacaaaacaacaacaaaaaaaatggaatcataaaacattgtataaagatgagtaaagaaataatatttaccctaaagtccaaggtcaaattgggctagcaaagttcactcagccattttggttgttatttagtacaggtcctttgagaaccaatttaaacaaataagtctgatccgttgctaacaggatccattgttaatatgtaaaaaggtgtctgagatcagtttagtctcttctaagttcttggtacaacctttctgcccaaaccaatttgtactgtcaatgcagagagtgtttttaaacacaatggcagtgctaatagatagcttgggggaaaaagtgggatgtttatgacttctaccttttctttccaaagccccaccccactgatccttaaaataagcacatggtctaggtagaaaccagttctcactatgccacacaactgcaagacatgttccccagcctccttctccatccgcatcaagaaagtttggagctgtcaccatcattacaaccctatttgaaataattacaaaatctagactcagaacagcctaaattttagggctttattatataacattctctttttaaatatgcggtagttacggtcaccttggaaagttctacaaaatatcccttaagttttttgaactttcccacatgggaatcttctggttatgagagtttgctctatttaatatgtgtacggtttcactgctagggtggttctcccacttatcttgaatctagtgtgagtgttttgaaatgtttctgctcattgaaaagaagcagagcaatagagatgagaggaaaatctgaaaagataatgacacaatttcccacttaattttcattaagtaagagatgaaaactttagcctcggcatcaggaagtttgatttctttaattaattttttttttgagtcagggtctcactctgttgcccagagtgagtgcagtggcatggtcacagctcactacagccttgacctcccaggctcaagcgatctttccacctcagcctcccaagtagctgggaccacaggcatgcaccaccacacccagctaattttttaatattctgtagagacagggtcttgctatgttgcccaggctggtctcgaactcctggactcaagcaatcctcccacctcagcctcccaaagtgctgggattacaggcatgagccactgtgcccgacctaggaaatttgatttttaatatacattttattctagttgacttcctaatctcctatatgattgcctgcttcttctaacgtgtcatttttgttttttaggattaaaagaaggatcttattgttaataccaaagtggctttatgaagatattcctaatatgaaaaacagcaatgttgtgaaaatgctacaggtaacctaacatcatccaacaaaaactgagtggcaattgagaccaagagtgcagtctaataattagaatagaatttccattcaaataaataaatgtgcacacatattaacataattatatagacatgtgtaaagacaaaactgtacctgtttcaaatcatacttaaaagagatgagacaatagagttgggggaaagaaaacagagaagaaataaagaaacaaacctgttcaaaagagaaaagtgaagtggaagattgtgggccttgtgcacgagtcacctggtgaccaaacaatggtagatgtcttcaggaacaaagggagtagggaagaaaagctcaatgaaatgagcctcaaagattcaaagggcttctgtttcacatgagatggagagccaggtggagcccaagaagggcatcattttactctttaaacccagtggaatttgagaaaagcaatgtgagagaactgtgaacaatagtgtcacaggggtgggctaggtttccattctggcaaagagaaggccacacaccaggaagcccctgagggtacagggacattactgattataaaggagggaaggaacaagctatgtgtgttcctgataacccctggccctcgggattggctgtcaaggggctcaaaacccagtccaagggacaaacacatcatccaagccttgcaatgcagtgatgtaagtgcaatgatagaaatgagcccaaacatgtgatgggagtggaaaggaaacactgaaaggagaggagctgctcaggagaagcagggagaattcaaagtcagggggacccctgggggttagaactgcatgttgggtaagaagatgaggtgtttgtaaaacaaatagaagtggctctgtttcaagctctggtaagcctattagctaactctttccccaacctcatgtcatctgaacaaagggtttctaggctaaaaataaaatactttttaaaagttcaaaaacaactggtcaacagaatagagtctgagttctgtaacacaagacttctgtgatctgatccactcaccattccagctttactccagccactcctcacgtcaagatttttgatgaagcaatacccaatgtgctgttcttacccaaacctggcaagctccctaaggaggctggggctgaagaaaattggaatgacacttcatgtctgtttattcaagatctccttctttgctaaactcctttcctattctgggctcctggaattagaggcaaaccttagggcttccctcagataaggttttgttttctgcccgagagactaaggaatgcttagtcggcttgggtggcttaaacaacaaacatttatttgtcacagtgctggaggctgggaagtccatgatcaaggagccagtcaattcacttgctagtgagggctgtcttgtggacagctgccttctcacatggcagaggaagagatcatctctttcctgtctcttcttcactaatcccattcatgaaggctccgccctcatgacctaattaccacccaaagtctccactttcaaataacatcacattggcttcaatgtgaggggggctggggagagggcacacaaacgtttagtccgtaacagggggctataatattataattgtgttgggtgacagtttgcccaggaaggccagccatctgttggaaggcctccagtccatttattgcccagaaaagtcatcaggctaaaaccttcacccaccctccttatcatcacaaacatgtctgaattgtgagtagctttatttatttatttgttgttttttgttttgagacagagtcttgctctgtcacccaggctagagtgcagtggcatgatctcagctcactgcaacctccgcctcccgggctcaagcaattctcctgtctcagcctcctgagtagctgggattacaggcttgcgctactacgcctggctgatttttgtatttttagtagagacagggtttcaccatgttggccaggctggtcttgaactcctgatctcaagtgatctgcctgccttggcctcaaagtgctgggattacaggccttatccacctttagaacctcggcatcaagcatttgtcacacactcattctcggtatgtgagcaaaataggattctccccaacctttttttatttaagcaacaaagtattttcttgtaacaagaaatattaatattaatattcttgcctcagaagaccaacttttaaaaggccctaaaattaagtaataagtaataagttaatatataagactcaacttttctctttaaaacttttaaaccaagaaatgtgcttaagaagtggattatttttactattccttttcttcagtcttctcatgcaaatttaataaagatttggaagcaagcaggataacaaaagacaaaaggaggaaatcatatgggaagataaacaatatgagaaaatggagggagaaaggaaagttgaaagaaagcaaaattcctatcctcattcaattatccagttggttcttttaaatgtcttttgcaaaataaaatgatgtctttttttcctaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctggaaaaaaaaaaaaaaaaaaaaaaaaagaataactaatacttgcttgcaaagggagaggcaagtttaattttcattttatcacttaaaattctcttgagtagataaaaatatagccccaaatgacaaaataagtgaagaatagaaacagaagagaagttagtcgtttgctgtattatttttttcccctactctccaggtattagggatttgatcttagtgtgatttgggactaacagcgctgtgaaacaataatgtgtggaatcatgggttgctgtcttcacttaagtcaagagtgatggccttgttttcctgtggcatagttgggatattatttatactataatagaacctatgagaggtaacagatgcaggatcagcaagacgtaattttttgtttacaaaccagatatatgttagaaaattattgttaaaacaggtatctgttcagtacctgttttgatggcaaatacttgctgaacctaccattgccccatatcccatgtctcctgcagatatcaccagccaatcagaacaggcctttctactgagctgtacaagtgccctcagaagcctcccaagcagtgttccttatggccacaatccataaggactggagtaggagattaaatctatctaccaatgatgtcaatatggaaaagtggttgatctttaaaaatgaaatacatattttaagctgagaaatgttacccagcagactattgtgattaatatttatgggcaaggacaacttttctgaatgatcagaacagtttaaaatagggtagagtagggcatgtaaattcatgcctatagtcctagctactcaggaggctgaggcggaaggaacacttgagcccaagagttagacactgcagtgcgctatgatcaatgatcatgtgccagagcaagaccccgtctctaaaaaataaataaatattcgttcattcattcattaaaataggtagattacacactgaatttctttttctcctccaacagttgtcaatttatactcatatttagtcatttaattttattatgaaaaatcaagcagttaattttaaaaagactcattgcttactatgtctttagcaaatgagcaggctattttgttttactttttttttttttgataaaaatctaaaagcaattttatggtcattaagtatccttgaaatgaggttgactgtatatcccagtttgccctggtttctgtccattgtcctattgttaattatgaccaataactgccctcattcactctcagaagcatcccttatttggataataaatcatatggtcactcaagactacttaatgtccagcatgtaagtaattcatcagaaatttatctttttttttttttttgcactgacaatcctctttattttactttttatcatttactaaggccattttgctccaaaagggtattactattcatactgtaaaaaaaagtatcccctgatacttttacatagtgtaaaaaaaaaaaaaagttatcccccagataaactctattctgtttatcctaaaatatgtatatattttttgtactttgcatattctgaaaggaatatattttaaatcactaatgaaatgctaatcttaaataccttgacttgtaaattgccgtatgcctttgcttgattcttttgcaaaaggagaatcataaagtagccaagaaggaggtagcatttgagattgaaataacaaaagactaagataaatctttgatgtttgcaaacctgatgaagacgtctggtaacatgtgaagaatatttttatagtacgtttcaccataattgtaatctatcacacatgaaaaaagcttttatcaagcttaaaggattacagcattgtttgatcttctgcaaatgtttccactgcagcgagtgcctccttttcgccccctagagtgggaaggaagctgctttctcattctgtggtgtcttaacccacatcactattcagcacaaaggagacacttctgattctgtctttgccattagcccttgttggtcccaatggactagaaattgaggctatacctgcaatgggagcaatgtacctgcctttgtcccaactcaggggaaaaattcaagctgctttatcacaatgcaaacttcgcgggggagaaagggtttctttctataattcttgtattcaagaaggattcattgaactactgaatgtccttactgttatatgtgcaaggccatttgaaggatatggatttaacaaaaccagtcaatccctgcaggcttggggcttatatcctagggggaagagacagacagtaaattaggacaagtcattgcccccaaggagcttacattttagtaggggaagaggccagaggtagggggtggagagaggcagaaaaaaataaaggaaaatgtcagataataagtgctgtctagagaggtaaaatgggataatgtggtggatagcaaatcggtggccactttacactgggtggtcaggaaagaccactcccaggaagtgatactgatgttcatctgagtctcaggtaagagccagcttgccactgacaaatccttctatagagaaagccttgagtggctaatgtctttacttctttccctcccgtacaacttgccactgattatcttccaccctgaccactccccacctcccatcttaaccttcttaagccagaattttctgcagattctgaggacaagtgcatacctattcatctttctatctagctcttgtgtctattattaactttctttctctgagtctcacaatcttttaagtcgctgattcctaaaggggcatgtcctgcttcttggtatgggtaaaggggaaggaagaagagagaaaaagcctctcaaggtatcaatcagagggaggaagggaagagaaatacaaagaaaggcaggttgatacttaggaatgctgaagcaaaatggagtgtcatagttctggacaacactaatgctgactaaggaatatcgtttcctcctgctctagtatctttctctccctctccctcccttttcttacataaaaaccaaggaggaggtgcaagtcaagtacagtttagggatgtttgcttggtacgtgtgcaggtgtgtacgtgtgtgtgcgtgtgtgtgtttaattggaatttctttccttttttttttttttttttttaacaggtcacccaggctggtgcacaatcacagctcaccacagcctcaacctcccaggcccaagcaattcccctatcccagcctcctgagtagcaagtgcacatcaccatacccagctatattttaaattttttgtagagacagagtctcatcattttgcccaggcctggactcaaactcctgggctcaagcaatccttccaccttggcctctcaaagtactgggaattataggcatgaaccactgcacccagactaaaattaggatttctttttagttataaatagtattgaagagaggcttatgagtttttaaggtgtggttttcaggtaatgtgggttgctgtttggccttccagtgtgttcccttgagtggctaattcttatatttagtcattctccctttgacatagagacagcacatgactatggcattgagcaaaagttttcaaaaattaattttagcaattgattctctttctccaaatgcaatctgttggctaggcacagtggctcacgcctgtaatttcaacactttgggaggctgaggtgggcagatcacttgaggtctggagtttgagaccagcctggccaacatgatgcaacccaatctcgactaaaaatacaaaacttatctgggcatggcggtgcctaacccaggaggtggaggttgcagtgagccaagattgtgccactgcactccagcctaggcaacagagcgagactccatcgcaaaaaaaaaaaaaagcaatctgttgtagaatccttaaatgtaaaacggatgaaagcaaatctcctgttgaaacagaccttggaggtcatacctgtgccctctgcttctccctctctcttctccgcccttgcctctgaagcaacatgaaaagctgaggctaggagctgtgctcttctatacttaggagactgggatgctggaccaaccttgagaagcctgtgctttagaactgaaccttactctgcactttagccacaggctatcaacgcaggctcaggggaccaaaaccaaaccttcctatactgagattaatgactgcaaaaagggctttctctcagaggctgctaatagaggcagttctattcacaataattaacttgcttctcccaattactttaccataaatgtctgggctttgttcaagtttatgttctttttaagatcactaagaataaaatactgtgttgtgaacataattagattttataaacccaaagactctggaattatgctgtggtttatctctttatgaagcaattataccaattatagaagataatgttttaatgggaaatattacccatttggcagacactattggtttaaaataaaagaagtgattaaaaacaacttatgaatctctcttgggtaaaagaatgaaaacaatataacataattgggttctgattcataaaatgaattgtacacaactttcttcgatgctgtagttaagacaaaattacaagaaagtctaacaaaggtttgacagaatgttattatgtgtctttcctactgctaagattacatcattaaaccccaattaatgttttatgttaaggctttcttagccattttgctaatttcacttttcaacttaagataaccacactgcaccttttagatccagaattcccatcaatttcctgaagatgcattcccattatgattattttcaggaatacaagttattatctaattctcataattagcatttagcaacagattaggaacttattcttaaatggtccatttttgtctggggtagtaaaagtattctgggctacttttatgagacggggttgggggggaaccctaaacaacagtgttacagaagcataactctttcctgagattgttggtttaaaaattcaagcaaaacaaaatgctgtttctaaccataaaggcatacctaaaattagagactgtcagagcacaggaaggaaatcataaatagccaaacactggaacacaagtgtgaggtacggaagtcaataaacgttactgttttctttctgttcacatcctgtctgagaattgtattagaggagagcaagagagaaagaatgcaacagtaaaataaagggaatgcatttttatttctgaactacacagtaattcatgaaaacacactttttaaaaatcaaaggaataccagtgtaaatggagtgaaaagtgacagttgctattcactcctttttttcccactcctaccccatcatcaaaggtaatgactctcagcaaattatgaggtttttcctagtatttttatttaaatgataaaatatgatattgtcctatgacatgctatttttaacctaacaatatgtctcagaaatcttcacatgtcattatatgtagctttaccttattcttttaaacaattgccctaataatctatagaataaatttcaataatatattaacctaatctattaatgaacatttaggttatttccaatttttcactagtacacctattcctttaataattcctcttgtacatatgtttatacacatataagaattttgtgtgttaggttgtcagggacagatacctaaatgtggaattgctgggccaagagacagaaaggaagataaaatcatttacattttgcagccaggtgtggtggtgtgctcctgtgatcccagctacttgggaagctgaagtaggaggactgcttgagcccaggagtccaacaccagcttcacaacataccaagaccctgtctcaaaaaaaaaaaattagattttggtaagtattaccaattatttctctaaaaagagtttgccaatattattagtacgtaaaatgtttgccaacctgatgggtatcttgtttgcatttttttagaagatgaggttgaatattttatttgtttattgcttttttgtatttcttattttttggttcacctttgttatattatttggtcatttttctactgagttgttggttatagtcttagtcatttgcaggagtgcttaatataaatcttttctgttatatatgttctaaatacgttttcccagcctgtgtgttatttttttatcttcatgttttcttttgccaaacaaaagttttaaaattgtatgcagtcaatctgttgccatttttctttatgacttctagactgggtatcatgtttagtgtcaaaagacaaaatcacaacaaatttagttcaaagatcttatgtggggccgggtgctgtggctcaagcctgtaattccagcactttgggaggccaaggtaggtggatcacctgaggtcaggagttcgagaccagcctggccaacatgctgaaaccccttctctactaaaaatacaaaaattagctgggaatggtggcacgtgcctgtaatcccagctactcaggaggctgagacaagagaattgcttgaacctaggaggcggaggttgcagtaggccaaaattgcaccattgcactccagcctgggcaacagagcgagactccatctcaaaaaaaaaaaaagatcttaattgaggtcaggtgctttggctcatgcctgtaatcccaaaactttgggaggctgaggtgggaggattgcttgagcttgggaattcaaggccagcctgggcaatatagtgagaccctatcactattaaaaagaataaagaattttaaaaatatttttaaaaaattttaattgtcttttatttgcaattctagaatcggacaacacctcatactataaaacagagtgagtgttctgatgagctgagcagaggaggttgatttaaggaactttcttatcacgctggcgaaaactggcctgtttagggatttggctgttatctctgtgtcctgatttgttgaaaggtcagataaagatcttagtttcagcaggttagtgtggaacttcagcatgactgactccagtttggttttgtctgttgggcctagtacaggagctcagtccaaaccaatgatctattatacatttgatttaacattagtaaaatatgtatttacgctagaacatgtagtggtgtaatatagtctgaacgttgtccccatctaatcttatattgaattgtaatcctcagtattggatggaggttgggcctggtgacaggtgactggatcacaggggcagatctctcaggaatgacttagcaccatctcttttgtagtaagtgagttctcaagagagctggttgtttaaaagtgtgtagcacctttcccttctctctctcttgcttctgctctccctgtgtgagatgcctgctcctgcttcaccgtccaccatgattgtaagcagcccaaagcttcaccagaagcaaagcagctaccagtgccatgcttcatgtatagcctgcagaactgtgagccaattaaacctcctttctttataaattacccagcctcaggtatttcttttttttcttccttttcaaaaacattttttttcaatttcatggaaaagaggtttttcatttttccaaaaattgtaccaaggtaaagcaaagttctagttgatgcaggtgcattgtataggcgttagcaatactgccctcattatgcactcattagacagtagtgcaaccccaagaaaaggatggttagatatttctttatagcaatgcaagaacagcctaacatacggtgatattaagcaatgggagaacagtgggcattagaagacacagatcagattagaatctacctttctggctggatgcggtagctcacacctgtaatcccagtactttgcggggctgaggcgggcagatcacctgaggtgaggagtttgagagtagtctggccaacatggtgaaaccctgtctctactaaaaatacaaaaaattagttgggcatggtggcacacgcctgtaatcccagctactagggaggatgaggcaggagaatcatttgaaccggcgaggcggaggttgcagtgagccgagatcgcaccattgcaccccagcctgggcgacagagcaaaactctgtctcaaaaataaataaataaaaagaatccacctttctcagaccctggctatgtggtttccagcaaacccttaaccaggaggattcagtttctttttccttaaaaaagatcctattaatatcttcctctggccattcgttgagaacattaaattaaataacatttggaaacactggcaggctagtcagagtggctcatgcctgtaatcccagcactgtgggaggccaaggccagtggatcacttgagctcagtacattgagaccagcctgggcaacatggcaaaacccaatctctacaaaaaattagccaggtgtggtggtgtgtgcctatagtcccagctactcaggaggctgaggtgggaggactgcttcagcctgggaggcagaggttgcagtgagctgagatgggccactgcacttcagcctgtgcaacagagcaagatcctgtgtcaagaaaaaaaaagaagaagaagaaagcactggcagagtgcttagcatgaagtaggcactggaggaattttgatacagtaagaataggaatactaggtacctgagaggagaggcagaaaatgtcagtggactaagtggagtgaaaaagaggcgaggaaacaggactagaaaactctaaaagcatgcactcttaggtagtgcagaagtgtttttgtccaactattaaatagcacaaccctaaattcctgtcatactcctgatctttcattttagtgttcaggatctcatagtaaacatgcaaaatttgatattcatttgataacggttgctgtgatacttattgcaaatctcttcttatctagatttttaaaatatatttttttgtagggatggggtttctccatgttgcccaggtcggtctcaaactcttagactcaagagatcctcctacctcagcctcccaaagtgctgagattacaggcatgagccactgcacccagtcttatctacatttaaacaaagtttagcatttattttattttgcggttcaatatagaagatttattttatcttagttgctgaaattggaaatcacttctgtttcaccaaatgaagagattaggattttaagaaactgccagctgctaagtatttgcagattcattctttttttagtattcgttgcacatcccattcaatgtgttactttggagattccatttgattgaatagaggcagcccatgcagaactctttgaagaacaggagggaggctgctgaagcccagagcaatgaagaaaagcaattctaatgtaagaaaaacaaagaacaaaaaaacagaagcactttgcaaacacaataaatgatattaatagattcaacccatcttcatcgctttaatgaaatgataatttttgaggcacttattaaaactcttacattgtcttttccattttgttgcttttgttttactaagaagtagaaatcttcagttagaaaaaaatcagaaaaacatgtggaactacaaatgtaactgatattacaaataggtagactaaactttattttttccttttaagagcttggattaaggtcaaacaatcagaggggattttgggtttttttgttgttgttgttttgttttgttttgttttagaggcagggtcttgctctgtcacccaggctggagtgcagtggtgcaatcatggctcactgcatcctcgaactctagggctcaagtgatgttcttgcctcagcctcctgaataactacgactgtaggtgcacaaaacatgcctggctaatttttttgttttttgtagagatgttatctcgctatgttgcccaggctggtcttgacctcctagcttcaagcaatcctccttccttgatctcccaaagtgctgggattataggtg

SEQ ID NO: 15 - DNA, 113993 bp, Homo sapiens
agggctgtccagctctcgggatctcttgacctgggcctggaggaagcccagggcagtgtgcaagcactccctacccacccactcccaccctgaccttctgctccttggctatcccaaccctcttgaggcacagggaaatcaattcccctttctgaaaggcaacatctaccagtaatttctggggactccagtagaaacataccggtctccccaaagagaagagactagataaatacagccaaactaagacccgtggaaaggtcccagcggaagagggaatcgtctctgttcgtccgcccccaggaggccagacttgggacctgtcacttggaaaattctcttgatctccattccccttgtgagggcgggcccacagaagggcaaaccgtcccgggacgtgcccccttccctcgccacctgccagggacagcttcgaacgaggcgggaggacagatgcctacttcagtgttgggaagggaaaggggaaaagaaagatgcaaggacctaagccaaggcgcaaagtccctcagattgcggccgctccagaggagtcgaccagcagcctggagtcggggttgaggtggagaggagcaggggccacggcgttgcccggtggacgagaataggagtgggtggcggcccggggacctgggaaagccgggacctgcgcgaaggctcggctctgcggggcccctgaactgcacccggaagatggcgcgagtggccgaacaccgtgacacaccgccagccctcaaaaccgtggctcttttcctcggtgatctccatgcgcagtcctcggggaacgcgtgggagtagcaggccaggggtccactggaaatccagaatctgatttctgtttccgattccctacgctccagagaaggcctcctctgctggcccagtatgaccgacacttcccggctctgggagcgcacctccacctcccaccccccatggtacatacagggaaactgaggcctagagaaggacaaagacacccacagacggctaggagatagagaccaagcaaacaacaccgcggggctccgtcccaggttgggagcgcttagtctgatacggccagaagcctggggcaaggggttcctacaggtctttctggggcgagcctgccaactctcttgggtttccccccgggcggccccagataataatagatcccatttgttgatggctttacgggcaggaactcactgaatatccgccacagaccacggcagataagaccactccggcgttttacaggtgagcaaacagagaccctgtgagcgaagttgaaaaacttgtccacggccaacagctaataaagtcgccaagccagaatatcgctaaagcctgtccccttaaatatagagccaaaccgtccacccagctgtggcgcgaatctcttgtcccccaactctcaagtgtcctttggctctggagctcctgggcccgggttccgcatccgggaggagaaaggagcgagcgcgcacggtgcctcccgagggcagggagcagaggagaggaaaggggaagactatgaaacgtcctaactaatgcgcgtactgaatgcgcattcacgtggtcagttaccgatgtgcttctctctctcctggcccgcagggacagagcgcgccagggacgtgccagccccggccccggctctgccacatttactatgtgacctcctgtcagtcattctctctcccagtcctagatgagatcttagagctcacgcaagcttgcctgttggaacagactaagtatctgactttgcggggatgttcctgatgcccatcgaaggacagaaatctggacacttgcggatgtgctttaatgggggagatgctgattctgccctggcgtgaccatagatagctagaagctgaagtcattctgagtcgggagaatacagttgggggcactgccggaaaggatctttaagtccgaggatgccctagggcgtgatcatatcccacccggtggcccttgcccacagtcccctagtccacgagattggaatccgatctgggaaggtccctgctcccttggtagaaggaggctctgggatgggagaagggagcttcttagcgatttgaaaattagcatcccttcagtagcgcaaaccttatggaagaaaccttggccttaaaacattctcagaggggagactgggaggaacaggcctgtttattcaggggaaagttggagaagggagggcgagtttagcagaaaagctcgagatgcctggataacaaaaagtttgcgctcatacttccttcgagggacaatttgctgaatatttacacacctttgcgtgctgcgaggtctttgttggctactgggatgcgagatgtgtatgatgtgaatgtgcaaatatgtttgcatgtgcgaaaagtggctgcacatttgtgggccagtgcagtaagtgtgtgtttgtgccggtgacagagagcacttggctgaatgtgtgcgtgggtgcgtaaggcattggtgcacacgggcgtgagtgcgcatgtgtatagtgtgtgcacgtgtcatgtgtagtgtctaagtgagtgggctgtgcatttgcaaaagtccgtgtgtattgtgcaagagcatcgtaaacgtgtgtgagcctgaactcacacgtggttttgtgtgcacgtgtgcgtatgaaattcagcaaaaaaaaaaaaaaaaaatccaaaaaaatctaggtctaggcagggtgcggaccgagggcccaagggcaggcgtgcagaccgctacgactttggctttagggagacgccttcggggcgcagggcccgcccgaagacgcgggttagcatacagctcagctccaggcaggcgatgcgggttcccaatgcgggcctacagattacgcggactgagctgggaacggtccctgctggacagttccgtgctcttaatccttcctcgcctacggtctctgattattgatgcttgccgtgtgtcctaaaagggaccgcttccggtttatttgcttatgtatttattatctttatcaacgttattttttggcagctgccgtgaagatgccaaacccaccaagactgcgctgccccacctctccgaggctgtcctgggagtgcgggtgacccgcgagctccagaatctttccttaaggtggagccacagcgccacctcgcgatcctccagcttccctccctcatggccacggaaggctggccctttctggtccaagcccccagggtcccacacttactggttttccatgcactttcattatttccctttctctctcttcaatgttcccttatcctgagtattgaggtccccaaacgcgcctttctaccccacgtttggacatagccggaatgtctacctccttctccatccggtgaagcactgctccccctaaaatcaccagctcaaaagtcacctctatgaaacctttttagacttttccaacgcagtcattcgtgcctttccctggtttccctactgctcgcatcacattggacaggaaatgctatttaaacgtttttctcctctccctaatcagggagctcctctgagaggagccatggctgtccttgcttattcaacaataaaacctagtatatatcaagtgcatactatggagcgtttaatgcactgtactgtgcaaaaacatattgtcttatttcattttcccagcaaaatcatgaggaaagcacgaatattgtttcccattttgcagatgaagaaactgaggttagagaaaataagtacccatccaaggtagcattgcagagcctcatccaagtcagcctgtcggatgccagagccaacttttcttaacctctgacttgcagacttattcagctgtatatccgtgggctttgtgataggaaaagacacagaatgagtacttgtgtgtttatgaataaatgtatcttttaaattatttcttctcctagagagttgggtgtgggaaggcactgcaattatcagatactttgattgaaatgtcaccacaattatttatctctaaagagtattcctctgctaagtagctaggagaccttggtcaagtcacttcatcctcagtttcctaagttctaaaagtaggttttctgtggaggattaaatgagaaaaaaaaatgtgaattacatgatatatagcattctagtcattgctcagtaattataataactcgaaactactgaaacacacacaaaaaaaacaaaacacaaaattgacttaccctagtcacacagaattccctgtacctctgtatgaaatcatcttactgttatatcttcattttcatcttagacatgaattatataataaatatttttagtttatggtggttagggtgttaatgttaaccctgctctgttacaaatatttaaggggtagtgggagagatataatcaaacagtaaaccagcaaactttgcctcttgtaatttcctcctgctttgtagatctttaccaagaaagatttaaagaaaggctataaaagtacttattggccaggcacggtgtctcactcctgtaatcccagcactttgggagtccgaggcaggtggataacctgaggtcaggagttcgagaccagcctggccaatatggtgaaaccctgtctctactaaaaatacaaaaaattagccgggcttggtgacgggtgcctgcaatcctagctacttgggaggctgaggcaggagaatcgcttgaacccaggaggcagaggttgcagtgagccaagatcgcaccattgcactccacctgggcaacaagaacaaaactctgcctcaaaaaaaaagaaaaaagaaaaagaaaaagatgcttattattctggaaagtacaaaactctattttttaatttaggggagattctgagctagtttaagtgtttccctacttgaaaacatcattgctaccaatacattaaaagtttaaaaatatgtgtctaagcaaatgattgtatccaaataaaagaaaactcaaataaaataatgtattactactaatatattaaaagtttaaaaatacatgtctaagcaaatgattgtatccaaataaaataaacaaatgaaggttgtctgaacatattctagaccttaagacatttcccaaaaaggttaagttttaaagatttaacatctctttctagagtgacccattaaacaaacattcctattgtcaattaggtgaaaatgaactttttcccctgttacggctataactttcctactgtccaattattttggaaagactgttgactagtattgtcatgtcataaacacatgatttctcctctgagaaatgaggctaataaaatccacaaaaggtataaacgtgcctccacattttgctggcccacagtccatttctagaaacttcactccagccccagtttaatttactttattgtacttgcttcccattctatgcaattctcttgtatagagatgaagaaatggattcaggaaactctataatgtgttaagatattttattgtacagctgatggatatttgggaatttgattcatattgatggtgtgagacactggcgttttgacaaagttggggtgtgttctgttttccttttttattcctattatggtggccattagagatgttcaccaaaattttgggttttcttcttccaggtgcatagaaggatggaagtattctgacccttctgcatttagctgtgatcttgtgatttgccctggcaaataatgaattagcagaagtgacatgtgtcacttacaggggcagaagcatgaagagccatagtgcaatttaccaaatccccttcccggtggcacagctgttgctgcccccaccagatggagtttccatcagcatcccacccctggcacagacgtgtggagtggagacatctcctacacccatagacatttagcaagaatgagaaataatcctttgttactgtaaatcccagagatttttctgtactgcagtataacctagcctctctggaagaatacacttagaaaggaaactcatcttttcttttcttttggggggcaatttgaaaattcttctcctagagtgaaaagtagactgccatgtctaattaaataaaataatcagaaaatgaaatcattcaactagaaatctgaatctcattttcttagtctattcatacatttccccagggtcaaaacatctggaaccctctgaaataaggagaataactaaattttacaaatacttaaaaggaatctcaaaattattgctagacctcgacaagaatattcagtgggtccttagtccacttgcagatacatcatgaagtgagttacataggttgtgattagaaaatactttattagcaattggccaggcacagtggctcacgcctgtaatcccagcactttgggaggctgaggtgtgaggatcatctgaggccaggagtttgagaccagcctggccaacatgacgaaaccctgtccctactaaaaatacaaaaattagctaggcgtggtggcacacgcctgtagtcccagctactcaggaggctgaggcaggagaatcacttgaacccagaaggcggaggttgcagtgagtcaagatcataccactacactccagcctgggtgacagagagacccatttcaaaaaaaaaaagaaaaaagaaaaaaagaaaaggctttattagcaactgtatgcagacataaagtaacttttctctctgcctcatgttcaattctatatcagattggcaaaaaggaaaaatatttgactaatcaacttgaatttaataacgtgatctagggcaagtcatttaaattttccagaccttcttgtcctcatgtggtgtgatggactcaatgtttctgccttgccccgctcctctgccctgccaaattcatatattgaaacccaaatgcacaatgtgatggtattacttcccacagataactaggaggtaattaggttaagatgagccatgagggtgggattagtgtccttaaaagaagaggtagagactaaagctagcaagcactctccatctgtctctctccctctctgtctctccctgtcatacgaggacacaacaagaaggtagctttctgcaaggcaggaagagaaccctcaccagaacctcatcatgttggcatcctgatctcacacttcccaacttccagaatggtgagaaataaatgttagttgcttaagccacctagtttgtggtattttgttatagctgtctgagctgactaagacaactagaaaataagagtagacaacatgaacttcagggtaccactcagttctactaagctagaattttgaggtatctgggtgatagcagtttcagagttgatgctacagtataaaaatcttcctgtgtctccatccccaacactattttgtgaatcttttttcatttttttatactgatctcaacttaaaacaactgcttcttaggcaaaataatacttctttccttaagcctcaaatcttttaaacgtgggaatctgctagaaaagtgtgctgtatagatttggggccatgtaaaatgctttgtcattttctagccaagaggagaaatttgcttctatattgaagagctattctctataggtttcattatctgataacctaaagagtttttctgtggattttcaggaaacttttgtgagaaaatattgactgtgcgatgagtgctatagggtgaaatcattactgtctattctttatccttggtgtggcatgattgactgccaagaataatattgttataataatttcatttggataataatttaaatttgacaaagaagtttcacatgagttactgccttgacttctcgtaacacaccatgcaactgacatttctgccccacttcacagaggaggaacaggtttagatccgcccatactgtatggttaagaagcaccagatttggggtgtaactcaaaagccacagctgcctatgaaatttagaaagctgtctgaagctttagtaggaaatagaaagtgtcggaactatgctatggagcacttttttataaaaagatgcaggatgctttctgttgcagacatgatcgctggtaacagatgcctggttcactctcatcctggccatacctgaggactatgctcctcttctagaagttcggtgcagtcatctgacttaattgattcagcgcatttatctgcaggtgagagaacccccagagcactcgttctcctcaaccagaaatattactgagggcagatccatcagtttgggtcctgctatgatgatcagtttgggtcctgatatccatacagatatccagccctggaaagtaaaaacaagcttcttttctgagcagttcatcatgtactgttttctttctgtgaacagaagattttaacactaagacgattttataggcagacacgtagaagaagctagcagaggtgtcttaaacccatttgtgcctatagagccatacagttaccccggcgtgaaaaatattaaccacctttttttttctgaacacttcatcatgtactgtttttgctcagtgaatggaagattttatcacaaagagaagtctgtaggcaaacatttagaagaaactggcagaagaagtttcttggaccatatatgcctacagggccatacagatgtccgtccctgaaaagcaaaaacaagtttcctttctgaacagtttatcatgtactgtttttgttcagtaaatggaatattttaacaccaagaggaatttgtaggcagacagaagaagcaccatgagctctttaccaatatgcaatggatttaatgtaagcaagtggtttaagccactcggatttctggcttgcttgttactgcagctgaacttagcttgtcttcactggcacagtttcctaattcaaatttaaatcttttgtaaaagagaactatctctgtagggtagacactcttatacttcagccatagacacatatctctcaaggagaaagtattcttctagacctctcatgtttttatttaaattaattttattatgtaacttaaatatgtgcaagcataaaactagagatcaattcttcatgcataacaatgcttaaacaatggtgaaactaaattgcaaactaaatgaaaaagaaaaaccccacaaaaccaaagatttataagtaaacaataataaaatatactggatgacattgttttgtggaaactgaattgcctctcaaatatcaacattgttttgaattcagtggagtagattcttttggatatggcatgcctttatagttatgccatttgtgatgatttaattcttccaccacttttctctttttgtgaaccagcacaaaacattccttagttcacagtatgtaggaaaagcttaaaggaataatttcagtatcaaataaatttcagccccttcttaccagcctatgacaattcagaattaccgctggcaccaataaacataaactaaaatttaagctcagaaatttcatgtcagtcttcagtttaaaggtattgcccagacgaatctgtttaacattttaagataatcactgaaatgaaaaccctaagttttaaatttcttattaacaactaggaaacttcccactctcaagaacacatttcagatgccactgaagtgcacactttaaaaacagttagaggagtacatgtcatgttaagtattaatatattttaccacaattaaaaaagattttttcagaaagaatagcacaagtatgatgagaatcttattgctactacaactacaaatattttgatgctgggtgaccttgaggcaagttgcttaacctctctgaacctcagataactcatttgcaaagcagttctgtctttggtttttgtttgcttgattgttttttttagagacaaggtctatgctgcccaagctggagtgcagtggctgttaacaggtgtgatcaaagatcatagcagcctcaaactcctgggctcaagtgatcctcctgcctcagcctcccaagttgctaggactataggctcaggccaccatgcccagcttaaagggttgttttgatgaacaaaaaggagagagtgaatggaagagtctatcacagtaccagtctatggagaactgctttgcattttccttctgggcaatagcaaggctgcatttcccggcttctgctgaagtcaggctgaggtgggattgaagaaagccatttccatagtccatcaatcctcctgcataatcttccactctttttctcccccttctgtgggctgaatcagagaatctaacactggactccgatgccctctggcaagacttagcaaattttctctgtaacaggacagatggtaaatattttaaccttcatgggccatacagtctctgtcacaactgcttctctctaccattgcaacatgagagcagctacaaagcacagatgaaagggaagtgaataggtgtgactgttccaataaaactttatttacaaaaaaagaatgtttaaaaacagtaggttggcagaggcaggtggatcatgaggtcaggagttcaagactagcctgaccaacatggtgaaaccccatctctactaaaaatacaaaaattaggcgggtgtggtggtgtgcacctctaatcccagctactcaggaggctgaggcaggagaattacttgaacctgggaggcggagtttgcagtaagccgagatcgcgccactgcactacagcctgggagactctgtctcaaaaaaaaaaaaaaaacaaaaaacagtaggtaggttggaattgacccatgagccgcagtttgctgactcccactatagggtatctcagagtcacaaaatggaaggagtctgtgtccataaactactacatgaggaaatagactttgtatgagcaagacatgaacatctattttgtcaagtcactgaaattttagagctgtttgacaatagactgctctaatactcaaacacatagatggctttctgtaaatactatacttcccttatctccctacagttcctttaaagacagggactgtggattattcaactgtttaccctctccagagccttcccaatacccattaatgaaataatataattcccatcagaaaaataatgatgtgtatgaagagattaatggatacagcatctataacattctaagtaagttgtcactgcctccccctccttcattccactgccctattcctagacacatatttgagatgttttgtgccccatcccagataacaagatacatgtatctgtgagatgattttctttctttctctctttttttttcttatcgcccaggctggagtacaatagcacgacatcagctcactgcaacatctgcctcccgggttcaagcaattctcctgcctcagcttcccgagttgctgggattacaggcacctgccaccatgcccagctaatttttgtatttttagtagagatggggtttcaccatgttggtcaggctggtcttgaactcctgacctcaggtgatccacttgcctcggcctcccaaagtgctgggattacaggtgtgagccaccgcacctggcctgtgagatggttttcttgggtagaatgaaagaagcttggctactgggtccattttatgtgaacatgttgctccctattatagtcagtccctggaacccattgtaaagtcagttctgggtttttgcttagctaccatgtagtaacagtcacagcctgtctcctgtcaccctaacaccatcaccattgccagtggatatttttacccctagtttatagttaggaagcctgagacccagagggattaaagagcttttccaaaatcatatggctggcaacactagtaatctgggctgcctgagtcctaaacatcattctaccccagcattgaattccgaggcctctagaatcttacctaccttccctgtttgaaatgtatttgtgggggaacaattgacctcagaatgagtaatttgtcactactctgagaaagtttcaccgagtttcacattttcccattacaaaaggaaaatgagaaaatatgtcctagatactacagagaaaaatacttcattgtcttaattgcctttctatttcaatcaaggaaggcatttaattatttctgaactacattcaaaactctctctcaagaatattactctccccaggtgagttaaccaaagctgtgcacaacatttctcaatctgaataataacatcaaaaaatttattgagcactttttatatgccaaactagtcaattctttctgtttatgacctcattgattcctcatggcaagtttatgaagtggaagcaatcattctctcttctaacaaatgaggaaactgaggcacagagggatgagatagtttgtctaagattgtaaggcattaggtggtgaagtcagcattggatcccaggccaagcccgaggccatcactccaccatgctgcctctcaagagaaagattcagtttcccctttgagatatccatttataagtacatgtgccaaagcaatgtgaagaaaccaacccagatgacttgattaagctacagaagggacatctggggtctcaagcctctggaaatcaaggtggagcatgtagaggttatgggatcaggagagacagagtttgacttctttgttttttctttgagaccaagtcttgctctgttgcccaggctggagtgcagtggtgtgatcttggctcaatacaacctccacctcctgggttcaagtgattctcctgcctcgggctactgagtagctgggattacaggcgcacgccatcaggccggctaatttttgtatttttagtagacacggggtttcaccatgttggtcaggctggtctcgaactcctgacctcgtgatccacctgcctcggcctcccaaagtgctgggattacaggcatgagccaccgtgcccggcctgggtttgacttcttaagcaacctgaggaatgatgtccttgctgctgagcacagctgccctgggccctggaaaacccacatgacactcactcagcacccaatgctggcttcattgtggctgttggaaaccatgtggaaaagaaataactttttttgtgatctgtacgttatggctattatttttttacctcgcttagcttttcaagagaatgaagaccagtcgacttagtatttgtactctgaaatcgaatggcatgaacacatgtgttgtataagtgagaagaagtattctcttgtgtgatggactatagccttcagaaagcacctactattaaacagaatagagattggattttgaaatatgtaggccacatcagtaggaaagttgacacttcaaattgctcacaaggactttaaactctacaataggtaaaatgtggagtaccttatgttttcagaccaaatgattttgtaatttgaattcaaaatttttttagtcttcacagtagtcttagcattaaaagcatagttatttttaatattttgataaaatattctatttcattaattttgtataagggcatgtgtgagaagcattgatatttttaaaatataaaaatacagcctctttctaataagcaagagcaattgttgatttttaaattttgtgtttttggaggcttccattcacaaatctgattgtttaaataaatctgtctccagtaaatatgttggcacttagactacgacttcagtttcttatgttaagatttgtggacttcatactgtcttgagatgtgcaaacgattgttgttaaataaggacttggataatattcttaaataactagaattagataaggaatctaagcaaagttaatttccccttccttttccttgatgctagtccataatcatatgcatagtacttcacatgcagttaagcactcaaattccattatgttgtggggatatcatgccaacttggatatactcaagaatgtgaaagaccaaaaatagtatcattgagcttctggtttccagccatggcagctaggtcattcaaatcaaccctctactaccaacatacacacacacacacacacacacacacacacacacacacacacgtcaaaataagtttgaactctcctgaaaaggactgaaaagaaaaaaacaacagtcggaaattcccaggacaatttgaggggacagatttgtaaccagaaaaaggactggaatatcagacacgaaaccaattaggcctgaaagcatttctggttatcgttcacttgggctctgctcaggggctgtatggggagaggcagcaaaggtcaggactcaaagccatccaaggtgggaaatttttaggagacctcctcaaattaagctaggatttcaatgagaatccacagaaccaacagaaggcagaaacatctgcactccactcctgtattgaaagtatcatacagactgaaatatcaccatagttaaccatgtgtaaagaagtaaatgacaaactctacaatatctgcaggaaacagaaaaactataaaatttgtcataccagatttgaaaaaaaaattttataaataaagactaaaataatgttaacaattcagtgaatggattcaacagcagattggataagagagaactaatgaatggaaagataaattaaactatccaaccgaaacatggagaaggaaaaataaaaacgagagtaagacacaaggaggatatagtgagaaatctaacattgtgtccttgggaggagaggaaagagaagatgaggtgcaggaaatgtttggagagaaaatggctgagaattttccagaatcgaaggaacatgttaaatctataaattgaggagatccagagaaccccaagcaagtaaaataaaatctgcaactagatgcactatagtaaaattgcagaaaaacaaaagtaaatagaaaaatatttaaaacagccagagggaaaaaagataagctacttttttgtgtgtgtgtgagacggagtctcgctctgtcacgcaggctggagtgtagtcgcgcaatctcggctcactgcaagctccgcctcccaggttcacgccattctccctccgagtagctgggactgcaggcgcccgccaccacgtccggctaatttttttgtatttttagtagagacggggtttcaccctgttagccaggatggccttgatctcctgacctcgtgatcctcccgcctccgcctcccaaagtgctggtgagaggtgacagcatgctggcagcccttgcagccctcgctcgctctcggcgcctcctcgaccttggcacccactctggccgcgcttgaggagcccttcagctcgctgctgctctgtaggagcccctttctgggctggccaaggccggagccggctccatcagcttgcggagaggtgtggagggagaggcgcgggcaggaaccggagctgcacgcggcgcttgcgggccagcgtgagttccgggtgggcgtgggctcggcgggccccgcactcagagcggcgggcccgcctgcaagccctgggcagtgaggggcttagcacctgggccagcagctgctgtgcttgatttctcacctggccttagctgcccccgcagggcagggctcgggacctgcagcctgccatgcatgagcctccccccacctgccatgggctcctgcgcagccccagcctcctggaggagcaccgctccctgctccacggcacccagtcccatcgaccgcctaagggctgaggagtgcgggtgcagggcgcatgggactggcaggcagctccacctgtggccctggtgcgggatccactgagtgaagccagctgggttcctgagtctggtggggacttggagaacctttatgtctagctaagggattgtaaatacaccaatcagcactctgtatctagctcaaggtttgtaaacacgccaatcagcaccctgtgtctagctcagggtttatgaatgcaccaatcggcactctgtatctagttaatctggtggggacttggagaatctttatgtctagctaagggattgtgaatgcaccaatcggcactctgtatctagctcaaggtttgtaaatgcaccaatcagcactctgcgtctagctcagggtttgtatgtaaatacaccaatggacactcagtatctagctaatctagtggggggacatggagaacttttgtatctagctcagggattgtaaacccaccaatcagcaccctgtcaaaacagaccattcagctctctgcaaaacagaccaatcggctctctgtaaaatggaccaatcagcaggatgtgggtggtgccagataagagaataaaagcaagctgcccaagccagcagtggcaagggtctggagtccacttccacactgtggaagtgttgttctttcacttttcccagtgaatcttgctgctgttcacgctttgggtccacactgcctttatgagctgtaacactcaccgcaaaggtctgcagtttcactcctgagctagtgagaccaggaacccaccagaaggaagaaactccgaacacatccgaacatctgaaggaaagcgctgtctttaagaactgtaacactcacggcgagggtccgtggcttcattcctgaagtcagtgagaccaagaacccaccaattcctgacacacagattagaggcatgagccaccgcgcccagcctgataagtaactttttaaagaatggcaattagaatgattccaacgaagagctagctcttctctcagcagcagtaatggtagagagaagatagtgaaatggtgtcttaagtgtaccaaaataaaatcgttgccacatagaattctacacccagtgaaagtgaaactaaacctgacagaatttgttgtcagcagattctcactacagaaaatcacttgctgtacctaggcaggaagacaatgacaccggaaagaagatctgagatgcatcaaactttgtggaacaaagcaagtaggtaatgtgggtaaacaaaataagcatcgactgtataaaatagcaatgagaatttctagtggggaaaaggggggattgattaaagtactggacaacaaaagcatatgagtttgaagaagggaaatacagaaataataaaaggttcttctttgtggtttccctgtgttccacgtttgtccaggaagggaataacattctgatcacttgtaaactttggtacactaattatggaggttggaatttctaggattagtttcctacccctgccataacagagtaccacaaactgggggacttaaacaacagaaatatattctttcatagtatcagaggctagaagtccaaaatcaaggtgttggcagggctatgttctctctgaaggctcttgggaagaagccctctttgctttttctagcctctagtagtctcaggcattccttggcttgtggcagtattactccaatctctgactctgtcttcactgggctatcttccccatatgtcactgccatctcctcttactaggacgccagccatattggattaggttgcaccctgatgacctcatcttaatttgattacatctgcaagaccctatttcaaaataaggttaccgagtggaggtgggaggttaagtcttcagtgtatcttttggagggaaacaattcaatccataatataaggtaacaactacacattatagaactagcgtgtgttacttccaaatgagtaggggaaatttcagcagtccctccttatcccaggtttcactttcctgcgtttcaattacccagggtcaaccatgatctgaaaataggcaagtatatgtctctaaaagaaccattgagttaaaaaaaaattgaagaaaatagatgagtatagtacaataagatattctgagagagaccacactcacataactttcattaccgtatgttgttataattgttctattttattattagctattgttgttcatctcttattgtgcttaatttataaattaaactctatcataggtaagcatatatagcaaaaaacatagtattgatagggtttggcactattagcagttccagtcatccactgggtgtcttcaaaagtatgtcctgtgaataaggtgggactactgtaatggaataatgataaatattcaggattaaaaatcataatgatgccaggagcggtggctcacacctgtaatcccagcactttgggagtcaaagcaggcagatcacttgaggtcaggagttcgagaccagtctggccaatatggcgaaaccctgtctctactgaaaatacaaaaattatctgggcttggtggtggacacctgtaatcccagctactcgggaggctgagacgggagaatcgcttgcacctgggaggcagaggttgcagtgagccaagatcgcactaccactgtagtccagcttggactaccaagtgagactctgcctcaaaaacagtaataataataataataatgatatcaaaacctaacaaaaacagtgtaagagaagaatataggttaatcctattcattaacctagatttttaaaaatttaaacaaaatattaacaaattgaattcacaatatacaggaaggacaatagctcatgaacaagtagaatttatcctttgattttaaggttgatgtaacataatgaaaagcaagtaattcaccacattaataggttaaaagaggaaaatcatattgtcttcatcacaatagaagcagaaaaaagttgttaatgtagataataatagtacatactacttagctttattgtgatgataaaatgaatctttatctagtaattagtgcctggcatgtagtaaacactcaataaaatcttatatataatcactatttataaactctaacaggcattttacacacatgtacagaagatacccaaatggctaaccacacataagaaggtgctcaactgtattacaattcaggcaaatacaaaataaaaccagagtaagatagtcttatacctatcaaacaggcaaaagttaggctgggtgcgatggctcatgccagtaatcccagcaatttgggaatatgaagtgggaggattgcttgagcccaggagttagagaccagtctgggcaaccacggggagaccccatctttacaaaaaaaatttttttttaattagctggatgtggtggcacatgcctatggtcccagatcttcaggagactgaggcaggaggatcacttgagcccaggaggctgaggctgcagtgagtctgtctgggtcacagaacaagaccgtgtttcaaaaaaaatagtcaaaagtttaaaagactgacaatgcaagtgttacttaatacatgtgagaactctcatacactgttaataagtacaaccactttggaaccaagtctgacattatttacaaaatattttaccctataatctagaaatttcacctctaggtatatactctacagaaatgccattaaatcacctaacatgtcagggatatatcttacttggtcgtagtgtataatcctatttatatattgctaaattcaaatttctaatattttgttgagaatgtttgtatctatgttcatgaaggaaattggtctgtagttttcttttccagtgaggtcattgtctggttttggtaacagggtaatagtgacttcatcaagtgagttcagaagtgttccctcccccctctatttttggaaaaagtatttgaaggattggtattatttctttaaatatttgattgaatttaccggtaaaatcatctggttctggactattctctctggaaatattttttaattgctaattcaatttcttttaaattcaaatatttgaggtttactcagactttttaaattgctaattcttctttttataatgttttggaatgcattgagtttatacaggtgtaatgatgtgttgaaatcttgtgttctccaaggaagcttctttttaaaaaaattatggtaaaactgcataacataaaatttaccatctgagtcatttttaagtgtacagttcagtagtgttaagtacagtcaaacttgtgcaaccaatctccagaactattttcatcaaactgaaactctataccactaaacatctccccattctcccctcctcccgcaaccaccattctactttctgtgtctataaatttgactaatctaggcacctcatacaagtggaatcatatagcgtttgtcttttgtttttgaggcagagtacccctctgtcatgcaggctggagtgcaatggcacaatcttgactcactacaacctctgccttctgcgttcaagtgattctcatgcctctgccacccaaatagctgggattatatgtacacaccaccaggcccagctaatttttttgtacagacagagtttcaccatgttgaccaggctggtcttgaacccctgacctcaagttatccatcttcctcggcctccccaaatgctgggattacaggtgcgagccaccgcacccagctgtgtttgtcttttttgtgactgaagtaagttcagagtttatttatgtggtagcgtgtgtcagaatttccttctttttcaaggttgaacaatattccattacatgtgtacaccacatttgttaattcattcacttgtcaatgaatgcttgggttgcttctaccttatggctattgggaataatgctgctatgaacataagtgttcaatttcttcacttctaatctatccatattttctatttcttagtgtttgtaatttacatttttcaaggaatgttctcatttcatctaagttgtctaatttgttggtataaagttattcataatattttcatataatccttttaattcccacagtgttggtaataacgtccattctttaatttctgattttaacaatctgtatcttctattttcttttctttgtcagacttgctgagaatttgccaattttcttaatattttcaaagaaccaacttttggtttcactgattctctttatgggatccactgatttctgctctaatattttttctctccttttgcttatagtttcttaaggaggaagtttagattactgattacctttagattacttttgttcttttctgatatagacatttagagctaaaattttccttctaagtgcttatttaatgcaatccatacattttctatgctgtgttttcattatcatttagttcaaagtatattttaatttcccttgtgatttcttctttgactcatgggctatttaaaagtgtgttgtataatttccaaatatttgagttttactcagaattcttactgttgtggatccctaaacctaatttaattctgttgtgatcagagaacaaactttagatgatttcaaactttgaaaatttgttgagatttgtttatggatacaatatatgatttatcctggagaatgttccatgtgcacttgaaaataatatgtattctgcatttattgagttgtttgttctataaatattggttaaattgattgatagtgttgttcaggtcttagtgttgttcaggtcttccatatgcttcttgtttttctttctatttgttgtatcaattattgagggtgaaatcttcaactattattgttaaattgtttacatctccttttaattctgtcaaattttgctttatgtgttttgaagctctattatttggtgcatagagatttataattgttatattttctgaatgtattaccattttattattataacatgtccttttgtctctgataatatttcttattttaaagattattttgtctgataaaagccattccaaccctatggttaatgtttacatggtatattatttccatccttttcttttaacctatttgtgcctttgaacctaaaacagatctcttatagatagcatataattggctcttgctttttcattcagtctgacaatctctgccttttgagtggagtatttagtgagtgtttagtccaatcatgtttaatgtaactgttgataatctttgcatttatgttagccattttgctgtgtgttgtttgtctcatgtatttcctttgttcctgctttactgcctccttttgtgttaaataaatatttttaatgtgtcatttttaattcctctgtgtacattttactatatgtcatttaggtgttttcttagtggttgtattagggtttacaatatgcacttcaacttatcacaatctacttcagaataatactaagtcatttctggtaaaatatagaaacattgctctaatacaggggtttccaattttttgacttccctgggccacattggaagacaaagtgtcttgggccacacataaaatccaataacactaatgatagctaatgagctttaaaaaaattccatgcataaatctcataatgttttaagaaagcttacaaatttgtgttgggccacatttaaagccatcctgggctgtatgtggcccacagaccatggggtggataagcttgctctaatatatctcttttttcccccttcattagtgctattatgttgtatagattatgtctctacattaactctatacaactagattgttataagtattgccttatacagtcttgtatcatttaaagaaattaaaagaaaaatgagaaaaacttatttctagagacttttacaatttcccacatatttgttatttctgacattcttcgcttattctttaggattacagctattttctgttgtcactttttttcagcctaacagaccttttctgtatttttgtaaagcagctctgctagtgaggaattctttcaatattcatttatttccggaacatctttatttttgtattcacttttgaaggataattttgtttgatgtagaattctaagtttgcaggcttttaaaaaattttcctatcagcactttgaatatagctttctactgcttttctggcctccattctttctgataggaaatcagatgttactaggattcttgttcctctgtgttgtggggtttttttatgtttttgagattttctctttgtatttatttttcaacaggttaattctgaggtgtctaaggaggatctttttgtgtatatcctacttgaaattctttgaagttcttggatctgtacattaatatattttcatcaaatttgaaatgtttttggccattacttttaggtgtttttctatctcattttcctttccatctctttctgagactcccattacacctaggttggtacatttaatattattccacaggtctataggattgtctatttctctttcatcttttttctccctatttttcagattcggtaattttcactgctctcttttcaaattcctggttctttctttctttcttttttcttttctttttttttttaaggtctcactctgtcaccctggctggtgtgcagtggtatgatctcagctcactgcaacctctgtctctcaggttcaagcaattctcctgcctcagcctcccgagtagctgagattacaggcgcatgccaccatgcctggccacttttttttgtatttttagtagagacagagtttcaccatgttggccaggctggtcttgaactcctggcccgaagtgatctgcctgtctcagcatcccaaagtgttggcattacgggcgtgaaccaccacgttcagccctagttctttcttttgctagctcagaattacagttaagcttctgtagtaaacttttcatttcagttagaatttttaacttcagaattttcatttgttttaaataatttttgtctctttattgagattctctattcagtcattgttgtcatgttttgcttcaatctttaaaaattgttttcttcagctctttgaacacatttataatagctactttgaaatttttgtcttctaaattcattatctggaaacactcagagacagtttcagtagactcagtttggtcatccttttggtttctttatatgccttgtaattttatattgaatattgaacatcttagctaatactgcagccactctggattgtgattttttcctcctagagttgtttgtttgtttgtttgtttgtttgttttttaacttagtaacttgcctgggctaaatctataaagcgtgtggccactgttgactttgatcagtttttatctttgtttacattttaaagcctggatgcctaggaattgcccttgacagcttagagttcaggttaagaatggtcagcaacagcactcaaacccctcaagccagtgaggctttcactctttgctaatgggctatgtgtggagtggggagtacattcaaaacttaggaagtttttaagtcaggcttgacttttattttctgttgggctttcttatttctcttctgttcatgtgtgcaggttctattggccaggcatgtgtgaatggcctgggttcaagcttatctctgtagcacatgagcacagcctctcgtcaacacaggatatgtggggagattaccaagcccctggggctatctcatatctgtgcgtccctgttaaatccctggaagcctctcggtccaccgcttgtcccaaatagggccataatctcagactagcagagctgctggctctccctatccacttgttactaagattgccactttaactgacaacattccaaatcaaggagcaccttctggcagcagcaacaaggctgtgggtctccatgacctggcccccgctggttgaactaccaccacagaactggcaggcggggagggaggggatgggagcagcctgggcaacaccaccacagactcatgctgttcttacccaaacttcaggacatttcatcagtttgtggtatgcttttggtcaactttcagagcactgaaattgttggttttgaagttttgaccaacttaatagttgctttttgaggacagaatttctctgccttctcattccatcatgctggaagttgaaagtttaaaatcattttttctatgtgcttctctgcatgaaaattagtgaaataattatactaattattattacataattatttcgctaattattgtaaaaataattatttataaacatttatttataaaataatcatatgtataattatatgtacttatactaattatacatataattagtataattttttaaaaataattataaatagttttataggtaattatataattattttcactaataattagtaaaataattatgcagataagtacatatagtatactaaatatatgtgaaataattattgtaatcagtatttccactaatataaataaatatatacttatataatagataataatattatataatataataataatgtactaattataatataattacataatagattattttaaataattatatgaagtaattattagtgaaataattattgtgcagataagtgcatataatacaattccatttatatctagttctaactgcgacaaaactaaactatatggtttagggatgagtgtacaggtgataatactataaagaaaagcaagtaaatgattatcatgtaagtgaagatagtagtcacctctaggggaagaaggggttttgattggaaatggatacatgaagtgcaaagatcgtttcttggattccagtactattctgttttttgacttgggtagtggttaacaaatcctcactttagagccatctcttcaaccgtgcatatagtctaatgcatgtttctccttgcatattatatattacactaaaaagttgtataaaacatgttaatttgttaatttatttaattaataaatatttattgggcaactttagtctaaaaggcacaattctaggcaagaagtatatacagtaatacaaagacagagaaggtctctgttctcatggaacttaaagcttagtttcatgggaaagatagacaaaaagtaaaccccaaaaaagtaatttcatattgcaataaagagtatgcagggtggcagacagagagaagcattgagtacgagggccttgagcttgatttgtccgattaggtctcatctagaagatgaaatttgagctgagaactgaagggtgaaatagagtcaggcatgtaaggatttggggcaagcgcaacccagcaaaataaaatagctagttcagagctcccaaaaatatctagagaaggagagagcaacttgcaaagagagtttgacttgcaagctgacatcaaacatctgaaagacgtgctttggatgagctcaagaatgtgtagccaggatcagtagaggaaagccatgaagggtgtgggtggctgagctctcttcaaggaaaggcaggatttgcaaccaccagatcttctcaagaggctacttgaagagtcagcacagccaatatcactgaaagtgattctcactctcttggtaaggtagtggccacatgttttttggccattctctttcccttggggaacagccctcaattttccctgtgaagaattacctctcctctattgtggcagccttgacttaaacagtgacactggccgaagggtggtcacacacctaagattgtccagatggactttcttccccaagactctcttctctgcagtggttaagtatggggttgggaagactatgcaaagctgaccaccccccgtggttgtttcaatggcagccttataatttctatgtagaagggatggggctggcagtctgttgagggcaggatttgggggaccactttaacctatcttcgtatagcattttgcataaaggtaagaaagctcaacttctcacacaaagaattagggtaggatggaggggtttaaagttcctccaaatatcctcaaatatctccttggagtcaccactgggtgacaccactggtcagtgcctgtcacctagatccccagaatcttcatggttcctgagtcgtcctagcctggttcttcagctgcctttttatttctggagaccccctttcaataacacaaataccctttttggtttaacttgcccagagttggtttctattacttgtaccacagaaggctgataggggatggggacggacccaggccctagatgagatgaaggaatttttaaagcctctttcattgctgtggttttaagataagcacaaatataattaggcctctctcataggaatcaatagttatagatgtactggaaagacaatacttggctcagtatcttaaacagacatgttggctctacacacttgcaaacaatgaaatcaagtataatttgcagccctggggatatagttccagaaagaggctcaaagtacacttaccagtggtattcagaaagccacggaaggggactctgccagaacaccatcgtccgcaggctgatgtcaacacataataaaacaatagagtgaacattgggggagggaggaatctgtaacataaagaagataatggaatcatcaacactgatcagcatcaggaacaaatggggctggaggaaacctgaagaattcttcagaaaatctcaagtaagtctgccagcagaaactaaccatgcctcacatttgatttccactggtatatttagtatatttcatgaagttgtgtaatatctgcccaccctgctttgaatttcagcatagttacagtgatgaaaactaacaaaaaacaaacaaaaaacccccaagagattcttactctgatttgggggtggggcctggggggtacagtatagttcaacataatttgttatagaaaaaaaagtttctattgattcataatcaaccttttcaatgatgatttttttgggggatgtgatctctctggacttttttttgggaaaacattgtttcctgctagacaaagagcagtctgttttgaacagtgaaactgacctctcagcttttgagtttctaatagcaaattaaatctacctcaccaggaaaagaaaattatgaagaggtaacttttataatgcaggaaataattggtgtattgatctttatgaatttcctgatttctttaccttataatggttttccttaatggcaacacatgcattaagaaaacaaagcacatttgatggaaattcgttgtcttcccctttttaaattatttagtaacattgggcagctaagaaattgtttctgcttctataaaaccccctatgctaattgtggccagcaaattagtaattataatagatgatacaaagcaggaaagggctaaactaatgttagggagtaaagaatgcaattagatggctcagcctaacgcatcttcactctgaatctctgtgaagaaggaagaaaaaagctctgcaccaaaattaaaggggactcgttttctgattgtgtcctaggggatttggagaaagctcaagcaatttgaaggataccctcaggttgtactcagcagaattcctgacctctgccacatcctatctatcatgagcctttatcaggaggagatggcacatcacaagccatttggtggcacgtaattgcttcgacattgacagcagaggggtatatatcacctcctctgttaaaaagagagtgagtgttttaagtggaagaagactgaatgtaaaggcaaatttaaataaacattaaagggaagttaaaccaatacaaaactgaaatggataccaaaataaaatgaaagcttaaatatatgttgaagaaaacatttaataatgtatgatttctaatcatgccctttagaaatattgaagaatcaagaataagaaaaaaaaaagaatcttatagcttagaacagcttataaaagcatgagactggttttggacggtacatgaagtattgtggttggttttgtaaactgcacagagagaaaggtcttctcagtctcaattcttctgctgacattgaaaggaaagtctcggggctggtctgtcttcaactcctcttcaacactgccaaatctcccttttaaaaaaaggaggaaaaaagagtagactcatgctctgagcctttggcaaacaatcgcttgaatttaattatattacgttgtttttattacatttatttttgtggttacctttatttatggcaagtgaactggtttccacttgtgatgggcctatgacatttttttctttatttacattttaaaaagctgagtcaacttaaaaacaagtactatataaataaaagctctgagtttaaaaacaaaacaaaacagaaaaatcagtagtgggttcaatgtcgttggacaaaaatcttgtaaggggcactgaaataattttagttgaaaaaacatcagtttaaagtcatagactacgagagcttgaagagactaagagcaggcaatccaagtctcctccacatgtggaaaccaagtccagagacggagcagtaactgcccggctcccacggcttgtaatcgcagaaacaagctttaagccggctgcctccttcctcgttgcttttaccattatttaatttgtaggcttcacaaaggctatatgtgttgaaattggctaaatgtgcccagtctagaaatgagtcaaagtcaagaggcaggccaccaaggaatttatgtctttactgataaaatttgtgcaacctgcaaaaccacagtgacatctagtggtattccttgaaaatgcaactttaaaaatatttttacatatttagagggtacaagcgcaggtttcttacatgcttagtagtgaagtctaggcttcactactgggtgcccatcacccagatagcgaacattgtacacaacaggtagttcttcaaccctcacgaccctcccaccctttcaccttttgtagtgtccaatgtctattccactctgtatgttcctgtgtatccattgatcagttcccaattataagggagaacatggggtatttgactttctgtttctgaattatttcactgaggataatggcctccagtttcatccatgttgctgcaaaagacatgattttattcttttttatggctaagtagtattccgtggtatatctttacttcatttcctttatccaatcctccattgatggagacagtcaggttaactccatgtctttgctattgtgcatagtgctctgataagcatattagtgcaaatatctttttttatataattgtttctttccctttgggtttatacccagtagcaggattgctggatcaaatggtagtcctatttttagttctttgagaaatcatactgttttccataaaggttgtattaatatgcattcccaccaacagtgtataagcattctctttacttcacatccttgccaacatctattgtttttagactttttaataattgctattctgtctgactgttgtaagataatatctcatggtttactttgtgaaaatgcaactcttgatgcaacccttgacttaagcaggcttgtcattaaaaaggaaacattgttttgtagaatatctcgtagtgtgggtttgtctatttcctcatgattagattattcttaacaagaatatctcagaggtgaaggagtatcttccttagtgcattatgtcaagaggtacatgatgaaggcttgttctatcattggcgatgctaacttcagtcacttggttaccgtgttatctcccaggtttatctcctgtagagttactgttcttcctttcttaatgatttgagggacaatattttgaggctatataagcatcattttccttttcaaactttcatccactagttttagtatccatggataattcttgcctaaatcaattattattataatagttgcaaaatgataattttctaattctgtcattcctttctccattttattagttaacattttactcaaagaggggctttcccgattcgcttatgcatgtttgcatttatttattagaataaactcatgaatgcttacacaatctacaatctatggatctagaattcatgagtctatcatgaataggttatatagtagatattatatatctttagatatattatagagtacatatgcatgtatagattatgtctaaatctataatctattggtattgttatgtatttctttttaaaaatataaatgtagaacatcacacactggggcctgttgggggttgggggctaggggagggaaaacattaggagaaatacctaatgtagatgatgggttgatgggtgcagcaaaccaccatggcacatgtatacctatgtaacaaatctgcacgttctgcatatgtatcccagaacttaaagtataataaaataaataaataaaaatataaacgttttgaaagtcaaaatggcgtgaagaattgtttcggattaaggagaccaaagagacatgacaactgaaaacaatgcataatcccggggtcaattctgcaagggacctcaggggaggcgctgcaaactgaaggacattattgcgatgatgggtgaaagctaaataattctgtgaagtagatactgcagattaaataataatactgtacctgtgttacattgtttggttttgatcattttactgtagttatgtaagaaaatgtcttgccttaggaaatacacactgaaatatttagggttaaaagggcattacatctgcggcttatgctcaagtggttcaaaaataatagtgtgagagtgtgtgtgtgtattgtgaagaaatacaatcaaatacatcctattgtaataggataatcaaatgttgcaaaatgttaacaactggtgaatctgggtgaagggtacataaaagttctagcaacttctgtaaatttgaaattaaatcaaaataaaagttacaaaaaaaggtaaaataagattttaaagaattttaaattgtctttttttttaaaaaaaaaaaaaaaaagagcaaaataaacaagtaaacttgcacctagaagcttgagaatgtcaaagtcctgttaagtttctttccactgctgcatacagtttgagataaagtgccgctcttttcattagggaattaccttgctagtcaaggaaatctattataaattactagttcaaattccctagatgcctgaaaaattcctcaaaggtacacacaattttataaaaattcacacatttaatgtcatcacatacagaaaactggctatccaggttgggtcctggcattgaacccaaccaaccaaccatctatgtttggactagaggaagctggcgatgaacaaataaacaaaagctcctctgaaatataattatcctcatcttaaaaggaaaagaaactggagtgctggcgaggatgcagtggtgagagtgagtcactggatctggagtcgcttcttaaggtggtgcaccagccctacccacgacctcatggttgtgagtatgtgtctagcctcctctctcatgattccccctctctgccctctttccttagcctcttccacccgctaaggaaactggagtgctggccaggatgcagttgagagagtgagtcactggatctggggggggggggaatttgatgcaaaagggaatgaattggtcaccagcaaaacgtcaattgacaggtaatgtgtattgcatatccttaggttgttctccttcataataagcctgctgtatgtattaataggcacactgctacatacgccttgaaaataaaggaaattgaacagaacttggtaccaggtgtgaactgagcgacacagcaccctcccagacatgacatttagggtggtgtggggttagttttccttagatcacatgattgtgatgcagagactctttcctgccctccgggagctgccctgcccagttccacttcactctgccaggcctagagctcctgctcctctgtctctgtgttccttgctgtctcttctaggaagcaaacattgtatagagaagaaaagcaacaataaaaaatatctgggctgggcgcagtggctcatgcctgtaatccagcactttgggaggccgaggcgggtggatcatttgaggtcaggagttggagaccagcctggccaacatggtgaaaccccgtctctactaaaaagtacaaaaattagcgggtgtggtggtgtgtgcctgtaatcccagctacttgggaggctgaggcaggagaattgcctgaacccatgaggcggaggttgcagtgggctgagatcacaccactgcactccagccagggcgacagagtaaaactccatctcaaaaaaataaaataaaataaaattttatatatatgtgtgtgtgtgtatatatatgtgtatatatgtgtatatatatgtgtatatatgtatatatatgtgtgtatatatatatgtgtatatatatgtgtgtgtgtgtgtgtatatatatatatatatagactttggagttacatagctgtgtgttagaatcacagttctggaacttactagttgtgtggtctgtggggttaatgtatttaaccatgcaaacttcaatttcctcgcctgtaggatgagggctattttgagtatatattctagacctggcacttataagggatgactgtacaataggtcctgggcaaagcattgtggatcatggaggatgtctggtccctgagcatcctcctctcttaccttgactgccacagtctcttgactgatctctggcatccactcgcgtcctccttcctgtccattgtccacccaatagcagtgtgagtttactgaaaggcaaatcttcagcaccaagtccaaacttcttaaggtggtgtaccaacccacccatgacctcatggttgtgagtatgtgtctagcctcctctctcatgatgccccctctctgccctctttccttagcctcctccagcctctaagctctagtgctgtccaatagacttttctgcaataatggacatattctgtatctgtaaagtccaaagtcatcactgatcacatgtgcccattgggcatgtgaaatgtggctaatgggactgaaggactgaatttttaatttttgaaacatttttaattcaaatgtaaaaagccatatgaggagtggctgccatagcggacagagcaaacacgtaaaacttcttcaagtctccaaccagctatgttctctcttgcctctgggtccttgcgtcactgttctcactcatgtaaatacttcttcatcctttatgtctcagcctacatgtcacatgctatatgcgttcatatgataggatgagatgtatataagctctgccactgacaaattttcaaccagtaaacattcattggtgcaagtaaggctgtgcctcagggaaataacccattaattgtaccttttgctttctaccaacagatgtgcagggtatttttccctctgcccttgtttgttcattaatccatggtaggggacaccaatggatggtcacagttatgattcctcccatcaatgtgttttgcttggttttcatagcatttttaattatttatttttggagacagagtctcattctgtcacccaggctggagtacagtggcgtgatctcagctcactgccacctccacctcctgggtttaagtgattctcctgccttagtctcctgagtagcagggattacaggtgcccaccaccacacccagccaatttttgtatttttagtagagatggggtttcaccatgttggccaggctggtctcaaactcctgatctcaagtgatccacctgcctcagcctcccaaagtgatgggattacaggggtgagccaacgtgcctggctggctttcgtaacatttttttaaatggagccaacattttaaatggaaaagacttcactaaacatatggattgggttcctggatgatctggaaaaaaaaaatcagtacatctaaccacactggacccatatccgtttctgttcagtgataagcagctgactcattccaatatggtagccactaggcacatatagctacttaaatataagttaataaaaatgaactaaaatgtaaaattcttcagtctcactagccacactcaactgcttgatagtcacatgtggctaatggctaatgtattggacaggatagatgcaaaacattttcttttcttttctttttttttttttttttgagatggagtttcactctgttgcccaggctggagtacagtggcatgatccatgatctcggctcactacaacctctgcctcctgggttcaagtgattctcctgcctcagcctcccgagtagctgggattacaggcatccgccaccacacccggctaatttcgtatttttagtagagatgtgcttttaccatgttggccaggttggtcttgaacccctggcctcaggcaatcaacccgccttggtctcccaaagtgctgggattacaggcatgagccaccgcacccagctgcaaaacattttcatcacagcagaatttctgttgatccgtacccctggagggtagttggggagggctgcttcctgcaagtggagcaagtgctcttcaagtctctgtggtcctcagctggcctcctttacccccttatgtcatctacctgatccctgtaggcatttgaattctagaacttggtctgctacatgcttttgggtttctgcttagttttgtgatgtttgaaaaacaccactaaccctatgccatctggaagctacgaaaaaagcactggaagttatctgaaaaaatgaatatgaaagtaaggataccaaacctggaaagtagtgtgtgtgtgcatgtgtgtgcgcgtgcacataaatgagattggtggttctatagtagaaattgttttgaagcaaatcatggtaggaaagcactgtgcatatacagtcaatattcagcaaaagataaacaaaagcaactaccagtccattccaagatggacgaataagaacagttccggtctgcagctcccagcacgatcgatgcagaagacgggtgatttctgcatttccaactgaggtacctggtttatctcactgggaccggttggacagtggatatagcccacagagggtaagccaaagcagggcggggcatcacctcacccgggaagcacaaggggttcggggatttccctttcctagccaagggaagccatgacacactgtacctggaaaaacggggtacttccacccaaatattgcacttttcccatggtcttagcaactggcagaccaggagattctctcccgtgcctggcccggcaggtcccatgcccacagagtcttgctcactgctagtgtagcagtctgagatcgacctctgaggctgcagcctggcatggggagaggcgttggacattgctgaggtttgagtacgtaaacaaagtggctgggaagctcaaactgggtggagcccactgcagctcggcaaggcctacagcctctatagactccacctctctaggcagggcatagctgaacaaaaggcagcagaaacttctgcagacttaaacatccttgtctgacacctctgaagagagcagtggttcttccagcatcatctttgagctctgagaatggacggactgcctcctcaagtgggtccctggcccccatgtagcctaactgggagacatctcccagtaggggttgacagacacctcatatagccgagttcccctctgggatgatgcttccaaaggaagggtcaggcagcaatagttgctgttctgcaatatttgctgttctgcagcctctgctggtgatacccaggcaaacagggtctggagtggaactccagcaaactccaacagacctgcagctgaagaacctgactgttagaaggaaaactaacgaataggaatagcatcaacatcaacaaaaagggcatctacaccaaaaccccatctgtaggtcaccaacttcaaagaccaaaggtaggtaaaaccacaatgatggggagaaaccagagcagaaaagctgacaattctaaaaaccagagtgccacttctcctctaaaggatcacagctcctcaccagcaatggaacaaagctggacagagaatgactttgacgagttgacagaagtaggcttcagaaggtcggtaataacaaacttctctgagctaaaggagcatgttctaacccatcgcaaggaagctaaaaaccttgagaaaaggttagacgaatggctaactagaataaacagtgtagagaagaacttaaatgacctgatggagctgaaaaccatggcacgagaactttgtgacacatgcacaagcttcaatagctgattcgaccaagtggaagaaagaatatcagtgattgaagatcaaattaatgaaataaagtgagaagacaagattagagaaaaaagagtaaaaagaaatgaacaaagcctccaagaaacatgggactatgtgaaaaggccaagtatatgcttcattggtgtacctgaaagtgacgaagagaatggaactaaattggaaaacactcttcaggatattatccaggagaacttccccagcctagcaagcaggccaacattcaaattcaggaaatacagagaacaccacaaagatgctcccccagaagagcaaccccaagacacataattgtcagattcaccaaggttgaaatgaaggaaaacacgttaagggcagccagagagaaaggttgggttacccacaaagggaagcccatcagactaacagcacatgtctctgcagaaaccctacaagccagaagagagtgggggccaatattcaacattcttaaagaaaagaattttcaacccagaatttcatatccagccaaactaagcttcataagtgaaggagaaataaaatcctttacagacaagaaaatgctgagagattttgtcaccaccagacctgccttacaagagctcctgaaggaagcactaaaggaacaaacaaccagtaccagccacttcaaaaacatgcccaattgtaaagaacattgaaggtaggaagaaactgcatcaactaatgggtaaaataaccaactaacatcataatgacaggatcaaattcacacataacaatattaaccttaaatgtaaatgtaaatgggctaaatgcccaaattaaaagacacagactggcaaattggataaagagtcaaggcccaccagtgtgctgtattcctattcaggagacccatctcacgtgcagagacacacgtaggctcaaaataaaggaatggaggaagatctaccaagcaaatggaaagcaaaaacaagcaggggttgcaatcctaatctctgataaaacagactttaaaccaacaaagatcaaaagagacaaagaaggccattacataatggtaaagggatcaattcaacaagaagagctaactatcctaaatatatatgcaccccatacacgagcacccagattcataaagcaagtgcttagagacctacaaagagactgagactcccacacaataataatgggagactttaacacctcactgtcaatattagatcaatgagacagaaggttaacaaggatatccaggacttgaactcagctctgcaccaagcagacctaatagacatctacagaactctccaccccaaatcaacagaatatacattcttctcagcaccacatcacacttattctaaaattgaccacataattgaaagtaaaacactcctcagcaaatgtaaaataacagaaatcacaacaaactgtctctcagaccacagtgcaatcaaattagaactcaggaataagaaactcgctcaaaactacccaactacctggaaacagaacaagctgctcctgaatgactactggttaaataatgaaatgaaagcagaaatatagatgttctttgaaaccaatgagaacaaagacacaacataccagaattgctggaacacatttaaagcagtgtgtagagggaaatttaaatgtccacaagagaaagcaggaaagatctaaaaacgacaccctaacatcataattaaaagagctagagaagcaagatcaaacaaattcaaaagctagcagaaggcaagaaataactaagatcagagaagaactgaaggagatagagacacaaaaaacccttcaaaaaatcaatgaatccaggagctggttttttgaaaagatcaacaaaattgagagtctgctagcaagattaataaagaagaaaagatgcaataaaaaatgataaaggggatatcaccaccgatcccacagaaatacaaactaccatcagagaatactataaacacctctatgcaaacaaactagaaaatctagaagaaatggataaattcctggacacatacaccctcccaagactaaaccaggaaaaagttgaatctctgaatagaccaataacaggctctgaaattgaagcaataattaataacctaccaaccaaaaaaagttcaggaccagacggattcacagccaaattctaccagaggtacaaagaggagctggtaccattccttctgaaactattccgatcaatagaaaaagagggaatcctccctaactcattttatgaggccagcatcatcctgatacgaaacccttgcagagacacaacaaaaaaagagaattttagaccaatatccctgatgaacatcaaagcgaaaatcctcaataaaatattggcaaactgaatccagcagcatatcgaaaagcttatccaccacgatcaagtcggcttcatccctgggatgcaaggctggttcaacacatgcaaatcaataaacgtaatccatcacataaacagaaccaaggacaaaaaccacatggttatctcagtagatgcagaaaagaccttcaacaaaattcaacagcccttcacgctaaaaactctcaataaactaggtattgatggaagttatctcaaaataataagagctatttatgaccaacccacagccaatatcatactgaatgggcaaaaactggaagcattccctttgaaaactggcagaagacaaggatgccctctctcaccactcctattcaacatagtattggaagttctggcccgggcaatcaggcaagaggaagaaataaagggtattcaattaggaaaagaggaagtcaaattgtccctgtttgcagatgaaatgattgtctatttagaaaaccccattgtctcagtccaaaatctccttaagccgataagaaacttcagcaaagtcttaggatacaaaatcaatgtgcaaaaatcacaagcattcctatacaccattaacagacacacagagagccaaatcatgagtgaactcccattcacaattgctacaaagagaatgaaatacctaggaatccaagttacaaggtatgtgaaggacctcttcaaggagaactacaaaccactgctcaacgaaataagaggacacaaacaaatggaagaacattccatgctcatggataagaagaatcaatatcgtgaaaatggccatactgtccaaggtaatttatagattcaatgccatccccatcaagctacctatgactttcttcacagaattggaaaaaactactttaaagttcatacggaaccaaaaaagagcctgcattgccaagtcagtcctaagcaaaaaggacaaagctggaggcatcacgctacccgacttcaaactatattacaaggctgcagtaaccataacagcatgatactggtaccaaaacagagatatagaccaatggaacagaacagaggcctcagaaataacaccacacatctacaaccatctgatctttgacaaacctgacaaaaacaagaaataaggaaagaattccctatttaataaatggtgctgggaaaactggctagccatatgtagaaagctgaaactggatcccttccttacaccttatacaaaaattagttcaagatggattaaagacttaaatgttagacctaaaaccataaaaaccctagaagaaaacctaggcaataccattcaggacataggcatgggcaaagacttcatgactaaaacaccaaaagcaatggcaacaaaagccaaaattgacaaatgggatctaattaaactaaagagttctgcacagcaaaagaaactaccatcagagtaaacaggcaacctacagaatgggagaaaatttttgcaatctccccatctgacaaagggctagtatccagaatctacaaagaacttaaacaaatttacaacaacaacaacaacaacaagaaaaacaaccccatcaaaaagtgggtgaaggatatgaacagacacttctcaaaagaagacatttatgcagccaacagacacatgaaaaaatgctcatcatcactggtcatcagagaaatgcaaatcaaaaccacagtgagatgccatctcacgccagttagaatggtgatcattaaaaagtcaggaaacaacagatgccggagaggatgtggagaaataggaaggtttttacactgttggtgggagggtaaattagttcaaccattgtggaagacagtgtggcgattcctcaaggatctagaactagaaataccatttcactcagccatcccattactgggtatatacccaaaggattataaatcatgctactataaagacacatgctcatgtatgtttattgcagcactattcacaatagcaaagacttggaaccaacctaaatgtccatcaatgatagactggattaagaaaatgtggcacatatacaccatggaatactatgcagccataaaaaaggatgacttcatgtcctttgcagggacatggatgaagctggaaaccatcattctcagcaaactatcacaaggacagaaaacaaaacagcgcatgttctcactcataggtgggaattgaacaatgagaacacttggacacagggtgggggacatcaaatgccagggcctgtcagggggtgggtggctgggggagggatagcattaggagaaatacctaatgtaaatgacaagttgatgtgtgcagcaaaccaacgtggcacatgtatacctatgtatcaaacctgcacattgtgcacatataccctaaaacttaaagtataataataataaaaaaaagcaactaccaaaaaggaataatgatcttcaggggtcacggataacataaatgttgggatctgggtaggacctagtgaactgggtgggtgggagggagtaagtgcctgttaaagggcagaagcccctgggctcctgatgaatattatggtggaaatgggctgagaccttctaatttttccaaagaatccaggaatccatactttttgtgtgaaatctcaccttttttattttttcgagacagtgtctcactgtgtcacccaggctggagtgcagtggtgtgatcacagctcattgcggcctccctcaacgtcatgggctcaagcaattccctcagcctcccaagtagatggaaccacaggtgtgcaccaccacaccagctaatttttgcattttttacagagaccaggtctccctgtgtggcccagcctggtcttgaacttctggcctcaagtgatacttccacctcagcctcccaaagtgggagttcatacttagcatagtggttcatagaagtatgaactaccatacacagcctgatttttaaatgttcaatttttttagaatcaccatccaagcaaaacaaaagaagtttgccagtcagattcagctcacagatgccagttcgccaggtctgagccccaaaattagcagcagcatgaaagtcattgaacttgcctgatgctgatttaagagaagattggttgttgagaataccaaggttcagagtggaggaaatcatgctacaaaccaggcacactgtcgcgagaagatctatctcaggtgtcaacggcaacagaacagcaaagtgctgatctcttgggacactgtgattcccaagctttggtgcacgctggaatcactaagggagcttctaagaattcccgtccctagcccaacaaaattagaatgtctgggtgtaggaccccaggtgatctcaatgtgcagcaaagtttgagaaccactatgctaagggactctctcttgagtctgagaacctgtctccacagtgttgataaagctggttttgggggagcggcgggtatgcctcacagaaggcaaggcagtatactcagttgtaaagatttgaaggttttcccacatctggtgaaaaggaatctgggagcgacaagcttaaatccatccttagtgactgaatttacgagcagtggactttgccaacagccatggttaggtagaaaagtttggtgctcctttaaaaaaataatcacactttattgttatcatttaactgtgagtcttccaagtgccccatgagagttctgtgagggcaggggtgatgtctggtgttagtctgcatctggttcctaagggctacttacaaatgtgtattggtgagatgccatggagacgtagggaaagcaagctactagctgggaacagggagggcttgcgggtgggactctggagaaaatgccaggtgtctatatcaaagaacaggggtgggaggtcttcggggtgggggtcaccttgtggcagctactgaatgaatgaaactggtgaagtccccagcacataaaagcatccaggagttacttcctaagatgctttccctactaccgcctccaattttaagtgcaagaatgaaaaatccaaaaaatacgtgtctgtgaataaacactgtaatgtattgcttaagtggattctgaagccagactgtgtaggtgcaagaacttactgctgtggactttgagcaagacatcaaactctgcctcagcttcctcatctggatatgtagatgataatgcctacagggggttctaaggagttcatgagttattcataaagggattagaaggccacagagtgtgagctattcttttcttggagactatcagtaaaaaggatatagtttgctaattatcagataaatgaaaatcaaaaccacaatgagatatcatctcacacctgttataatagaatctctattatcaaaaagtcagaggctgggcacggtggctcatgtctgtaatcccagcactttgggaggccgaggcagacagatcacctgaagtcaggagtttgagaccagcgtggccaacacggtgaaaccccgtctctactaaaaatacaaatgttagcctggtgtggtggctagtgcctgtaatcccagctactggggaagcgtgggggagagaattgcttgaacctgggaggcagaggttgcagtgagccgagatcgcgccactgtactccagcctaggcaacaagagtgagactccgtctcaaaaaaaaaaaaaaaaagtcagaagataacaagagttaccaagaatatggagaaaagggagcccttgtaatccgttgatgggaatgtaaacttgcacagccatatgaaaaacagtatggagattcctcaaaaaattaaaaatagaactaccacatcatccagcaatcctatctgggtatatatccaaaggaaatgagatcagtagcccaaagaggtatctgcatatctgtgtttattgcagcattattcacaatagctaagatatggaaataacctgtctgttgatagatgatttgattttaaaaatgtggtatgtgtgcatacacatatacacatgatggaatattattcagcataaaaaggaaggaaatcctgccatttgcaacaacatggaggaacctgaaggacattatgctaagtgaaataagatgcataaagacaaataccacatgatctcacttatacataaaatgcaaaaaagtcaaactcatagaaacagaagggattggggctagggaaaatggggagatgttggtcaaaggtacagactttcagttatgagatgaatacgttctggagacccaatgtgcagcatggtgactgtagttaatgataccgtatagtatacttgatatttgcttagagtgaaccttaagtgttctcactacatatgggaaaaaaagggaaactgtgaggtgatggatatgtaaattagcttgattgtggtgatattttacaatatatacacatatcaaacatcatgtacaccttaaatatatacaattgtcattcatcaattatacctcaataaaactagaacaaataactaaataaataaatataaatagtatggttttaaaaaagaaagtaaaaaggacatagtgtttcttttgatgtatgtgtcagatgtttggataacatggaccattagctcagttgaccagaacagagggtaaataaggcctgggggggtcaaagcccaaggaggagaggaaaggcaaatagttctctagttttcagactatttctctctttaagtacatggtagtagtcactgcaagaattggttaattcagtgagaatgactaggcacacactgatctcctcatccccatgctggtggggggcagttggcgggggaccctcaaagttcatgtcatacaatgatgtgttactaattgtccttttttttttttttccaagacagggtcttacttcatcacccagtctggagtgcagtaacacaatcatggctcactgcagctccgacctcccaggctcaggcgatcctccggcttcagcttcccaagtagctgggaccacagctgggagtacaactgtgcctccacatccagctaatttttcatattttatgtagagacaggatttcgtcatgttgcccaggctagtctcaaatttctcaagagatctgcccgcctcccaaagtgctggggttacaggcatgagccaccgcgcctggccaaatggtactttcctactagattctgaatgtatcacattgcatctgagtttattgaattccatccaaccatctttttataatttttattttatttcaatggtttttgggatacaggtggtttttagttacatggataagttctttagtggtgagttctgatatttcagtgcacccatcacctgagcaccgtacactgtactcaatatgtagtcttttatttctcacccccttccaccctttcccccaagtccccaacatgcatcgtattgttcttatgcctttgcatgctcatagattagccctcacttataagggagaacaaacgatatttggttttccattcctgagttactttacttagaataatggcctccagctccatccaagttgctgcaaaggccattattttgttccgttttatggctgagtagtattccttgatatatgccacactttctttgtccattcgttggctaatgggcttttggtttggttccatatttttgcaattgtgaattgtgctgctataaacatgagtttacatgtgtcattttcatataatgacttcttttcctttgggtagatacccagtagtgggattgctggatctaatgatagttctacctttagttatttaaggagtctccatactgttttccatagtgattgtattagtttacattccctaatattttctcccattctatgggttgtctgtttactctgctaattatttcttttgctgtgcagaagctttttagcttaattaggtctcatttatttatctttgtttttgttgcatttgcttttgggttcttggtcatgaactctttgtctaggccagtgtctagaagagttcttccaatattatcttctagaattttcatggtttcaggtcttagatttaagtctttaatccatcttgagttgatttttgtatgaagtgagagataagaatccagtttcactcttctacatgtggtttgccagttttcccagcatcatttattgaatagggtgtcctttccccagttgatatttttgtacgttttgttgaagatcagttggctgtattcggctttatttctggattttctattctgttccattggtctacatgcctatttttataccagtaccatgctgtttgggtaactatagcagtgtagtataatttgaagttaggtaatgtgatgcctccagatttgttctttttgcttagtactgctttgactatgtgggctcttttttggttccacatgaattttaggattgttttttctagttctgtgaagaatgatgatggcatttagatgggaattgcattgaatctgtagatttctttggatagtatggtcattttcacattgattctacccatccatgagcatgggatgtgtttccatttgtttgtgttctctctgatttctctcagtagtgttttgtagttttctttgtagagatctttcacctccttggttatgtatattcctaagtatttttttttgtagctgttgtaaaagggattgaattcttgatttgattctcagcttggttgttgttgatgtatagtgatgcccctgatttttgtacattgattttgtatcctgagacctttactgcattcatttatcatatctaggagcttttcagatgagtctttagggttttctaggtatatgatcatatcattgttgaacagtgacagtttgaattcctcttttccaatttcgatgccctttatttctttctcttgcctgattgccttggctggaactaccagtactacattgaatagaaatggtaaaaatgggcagccttgtcttgttccagttctcagggaaaatgctttcaacttttcccaattcagtatgatgttggctttgggtttgacgtagatggcttttattactttgaggtatgtcctttctgtgccaactttgttgagggcttttatcataaagggatgctggattttataaaatgttctttctgcatctattgagatgatcatatgattttttgtttttaattctgcttatgtgatatatcacatttattgacctgtatatgttaaaccatccctgcatccctggtgtgaaacctacttgatcataatgtattatctttttgataggctgttggattgggttagctagtattttgttgaggatttttgcatctatgtttatcagtgatattgggctgcagttttctttttttgttgcatccacacatctcctaagtggaatgtaatctatatatacacatacatttgactaagcaaaatgtttgtttttatttgcatgtgtgatttaagaagtatatttcggccccatattacattaaaaatattcaagttctggctgggcacggtggctcgcctgtaagtgaggtgggattacgcctgtaatcccaacactttgggaggctgaggtgggcagatcagtcccagctactagggaggctgaggcaggagactcgcttaaacccacgaggcggaggttacagtgagccaagatcacaccaatgcactacagcatgggcaacagagcaagactcggtcttaaaaataaattaattaattaaattaaatattcaagttttttctaagtagttaatattgcgtctcatctttttaaaaataaagttgttttttcctttcccttgaaataacaagtacactttggtggcaagcatttcttttccttttttttgttattattattattattattattactattattttgagacagggtctcgctctgtcaccctggctggagtgcagtggcatgatcacagccactgcagccttgacctccccagtttggcaatcctcccacctcagcctcccgagcagctaggattacaggcacatgccaccatgcctggctaatttttaattttttgtagagacaggttctccctatgttgcccaggctgatctcaatctcccgggctcaaaacatcttccctcctcagcctcccaaagtgctgggattacaggtgtgaaccacctcacccagctgagcatattcatttatcaggtatcatttgttcaagctatatgtgctttttttcttcttaaatgtagaagaaactaaaaaacctaaacccataacaaaagataaatggcaatggcatggaggcaggctgtaagcctgtgagatacaggttgaaagtctaaaatgttatgatacaagttagctcagcgaattggcttccttctcctgtgaacatacttttctaacatacatggcctttccgatatcagtcccccaccagcaacagcaccagcaccaaaacacatacagaggtcaccatctcgcaagtttattcgtttgagttgcacaatgtagctcataattacaaaaataaacataatggcccccttaaaacttgggctttctttttaggggtaggggatgagtttcaaggtaattttgggaagatgacttcagaaaagattttctaatcaactagagaaaaaaaatgggaatttacaatgtttatgtctatctatccctcacatgtgtttcttaggacgatttaatacttatcttgggaaggaagcagttttatattttaaaattctctaaactaaggcttgactcctattttaaacacagcccatctgttcctgcaaatagtgtgattacacagtctgcacagatctgtggctttaactaatatgcagaaggcatttttatattaaatggtacgtatttaatattaaatgttggtattttgtagccaacagtttccaactccaaatcttgatgggttgtggcttgccatatactaagatttattctacatcccatatttttttactgtttgttttccctttttacataatttgccagacgtttgatctcaaattgataattttaaatattataatatctcagaaattgtttcagattttcacatctctcgtgtaacatctttaaagttaatataagttttattgaatgcagcaaaatacacatgggtgtttggatctttttgaggtgagaaggtgtaacggaaagagcattggactggattcaggagacctgagcacccttccccgctttgccatcaattgtgtggccttggacacatcgataattggctctcttgtaaagtaggaccactgatctagatctctgaaggctggtttgcttccaaaattctgtgattctttaattccatatgcttgggaaagaggaggtggagggggtgctaacagcattttaccttcaaatataaatagcttgagacacttttgggtggtcaaccaaccaaaaaaggttggtagattaggccagatggcacatgcacacctgcataatgtgtcggccaggctttgctgcttcactgcagaaaccccatcggttgtaatgtttgctgaaatccttaaccaccaatgtttcccagaggcaaacctcatgtgtatttcttctctaagaatcttcttccataaaaatggtagatccaagaacaagcagccccctctcactgaaatagcaggaatatttaaatgaaaggtactcacatttccatagaatcagaatcatctgaaaaattggaaaaggtaagataccaggctccatcccaaacctacccagtcagaatctatggcactgggtctaggcatcgtatttttctttttttttttttttgagatggagtctcaactctgttgcccaggctggagtgcagtggcacgatcttggctcactgcaacctccacctcccaggttcaagtgattctcctgcctcagcctcccaagcagctgggattataagcatgtgccaccacacctggctaatttttgtatttttactagagacggggtttcaccatgttggtcaggctggtcttgaactcctgacctcaggtgatccacccgcctcagcctccctaagtgctaggattacaggcgtgaggcactgtgcccggccggcattgtatttttcacaagcttcccaacctgcttccaacgcccatcaaaggttgagaaacactgctcatggaacaacttggtgataccaaaatgcaaaattctagcatagatccaaattgaaaatatcttcaaataaaacacttgctcattgattttttttttcttttactgcactccggtcattaaagaaaaacaaacaggttctatacttccataaatgaatgtcaaatttatacacattgcttctggtttttaatcttttcactttaatcaataccgaatatctgcactatacatattcatataggatttgactgtgattaaatgagatgtcgaatttgcccagtgttcacttacggcatcctctaagcaaacggaagagtctgatgacagcaatctaatttgctagagcaagctgtggtggagacgacaggggtgaattagaaactcagcccatcccagcttatgcggactgttgccaagcaaggatgagtggcctatgcagccagcacttccaatttttcacaagaaaatagaaattgagtttgtcatatacaatcttgcaatttttaaatggttggcaactgattcaaatattttttaaaatatcatttaaaaatgtaccattgaggctgggcatggtggctcatgcctgtaattccaacactttgggaagccgaggcgggtggatcacttgaggccaggagttcgagaccagtctggccaacctggtgaaactctgtctctattaaaatacaaaaattagctaggtgtggtggcacatgtctgtaatcccagctactcgggagactgaggcaggagaatcacttgaacccgggaaacggaggttgcagtgagctgagattgtgacattgcactccagcctgggtgacagagcaagactccatctcaaaaaaataaataaaataaaataaatctatcactgaggcctaacaacaaagcaaaatttatcagcccagatttcccccagaaggccccaaatttgtaatttctgctctagaaactgagttcaggatctgatcagttaagacgatcaaaacccactcacagaaattacttcatttagttgccatgcaatattatgctctctgcctctggaaagaatagaattctctgccatttttaaactacagggtggatatgaggagccacctgctaagttcctttgttcattctgtagatatttagagtgctcctgccctataccagacactgggaacacagtggtgaaccgaatcttaggtaagtttaatatgtagcacagcatattaaaaaaaaaaatgaagcatctgtctctagtttaaaactgttcaaaaatatgaagctcattactcagtcagtggtgaggattaaaaatacagatgggcaaaacctgaaacagaatgacacttcagtgatgattttttttcagatgaggctgatgcccagaaaaacaaaggctaatcaaagatcacagaggacttagaattataatccagagctcctgcccttagtgcaagccccttttatccctctgtgctgtccatttccctaaatccaagaggactgataaaggattgtcacagtactaattttgatggcaaagtgcataaggtgacagaccttattacaaagtttttaagggaatattgatgcgtgaaaataggtatgcactgtctgaaaacactggaaaccattaagtagacaagaaaagtgacctaaaaaggactcataagggaactgatgattctctcaatttgatcaagcataatagaagaggaactgaatctaattttctcatcttctcttcagtagaacaaaccaggtggttaaactttgtcttcttcctaagtcaaaaactctgcagtgagttggaagctattacaaaatggctagattttgaatacggatggcattatacaatgctactgtccagtatgtaaggacaaataacaaattaagtcagaggtatatttggaaccattcacaggtgtgctcccaaatttcaaataatctgtaaaatgaagttgctccaccagagtgctggtcactgatatgctctctttctaggacgtggaagacaacttctgtgctgttgtggctggtggggccatatcagtagttccggccaagggagtgagtggaagtgacatgtccataccagggaggaacgtgtaattgctggtgtacagccttgcagtcttccctttggcatgaccatccagaaagttcaatagtgtctgcaccaaacaggatagtgtctgcaccaaacaggatatccttgtaatgtacgtgcatgacataaatctttgtggttttaaagccactataattttgaggttttctgttacaaccacataatatattcctcctgacacacagtgacatttgtccaaaaggctactaacacactcatctgatttggcatgtacagctgggatctatttgctattaagaagtaaaaagtgtattataatgtggaaagtaattccaaagaactctacttttattaaaatcccagatcattactgctaggtctttggataagcagccttcctaccactagagggagctatctgctttgtcttctgcctaacacggagcaccaaaaagatgataaacttccagctacacctggggagaaatgaattctagcctagatactttccccccgccaacaagtcatactgccttagtgctaggctagctggatagaagctctgaaatgctcaggcaccccaaaaggctgattcaatctgaatcagaagtaaggttcagaaatgtgtacttttttaaaataaaaagcttcccaaacacttctgaagcacaggtaagtttgctaacactgggtgtagaagatttcaaaagaaatggtccttttcaatcaaagagttttgccatctacagggcatttctgacaaggatcaacatgtaagtccaactaaattaaaaacagaacctcctaagaacagaacttcaaaaaaagcactttataatgacaacaaaccacaagaacaaaacataattatcttcaaatttaaatttattaagacattcagctatgtctgtcagtctacatccaaatttgctactaaaaataaaataaagtcacatcccacattaggaataccgaggtctgaaaaacactttttgagccaagcctattgtataaataaatgactagtttcttttcatatcaaaattcccataaaaaattacattcccccctccccagttctacctgtagccatgatgaatgtaaaaatttaaatatgacacatccttgtcaaagaaaaggtgcaaagtctattaacagctttaaaagtggcatttgcagagtgtgatcatacagttatgtactcattcccaaagtgcaaatattgccataatttaacactgttttgattcagttgcaagaattaaacattacacaggattgaaaagtacacccagggcctctatcagtgccctaaagcccttcccactttggtctccttcactaaagcagactccaaagtgttcatcagagttttagtttacttcacacagccagcgaagtatacaacatatttaacaaaagtttcatatacatcaaaatactgaagactccgtcataaagttcaagagtctcagattacatgaatgcacccgcaaggcccaagtgcccacccaccccttccctaaagcacatacaaagtatgagcgtgcttcaatctttgaatacaatcaatgcttcttcatctttgatttcatttcagtgctgtacaagactcaataatcacctgactgagctccaattaactgaggagaaacggggtggaggagagggctggttgctattcagacttgataatgagattgatctgtcccatggagagtgaaagttcagttccacttctgcctccttctttccatgctgtcctcatgctctttatcctcacttcctcagtcccttcaacactcaaaatctgattttatttctctctcacacgtatcaggggcagtttctgaagttgctgaggttgaattttcttcacaaacctctataaaacatcagcagagaacatataaatacattttgattagcatacattgcaaaatttctcccacaatgtcaggggatgaaagcaggtggtccccactgagagtacttcctggattagatccttggaatgtcagtttcctgcctgatcatctcattttcattcctcaaatcagaacatgaattccatcttgagttaacttctcctccagagtatcaaagcatcattcctgctgcttctcctctaggctgattcaacaggatgtgcttcatctttcgcactgtgaggatattctttggggtcaaaagccccttcctggttatctggtcgtctggcaatgtactcattattgtccctggaaccttcctgtatcctggtccctggagtatgctcctggcctgggggttcagtaccttcctgaaacatgacgttttgctcagctccagcatgaggctgtagaactggctcagttcctaatcctggaagctgggaggagtttttcagatggcagtggcacagagggcaggtctcctggacatacagccatttcttaagacagcctgcatggaaaaaatgactgcaaggcgtgatcacagcagatttcatgtcctaaaagagggggaaaaaagataccttataaatgtctgttttctagtatctttggtgctatccccaaagttctggttctaacatctctttcccacaatagaaaatttgtaacatagatcttagaataaaacttactttatatatcagtaataatcctgctgccatcacagatcccccttatacaaataatgcaagaactactggctaagtactttctaaaagtgaaggaaaaaccaaaaatgaggaagaagctacctttataactgggttttgcctgagtatgaaatgcaagtgttacacaattgttgcagtatgattactgggtctccactggtatgacaagagtataattacaacctcagaaaatctgatgaagacaggactttttctacagttttgcttcaacacagctgaacagtttataatgaaattattggcaaagagacaaaatcggccatataataccagggtattggcaaggaagtggcactctctcattacggacaatgtatatacccagttttcaagatttggtctatataagccagtgtttctcaacttgcataagaaccacttgttaacacatagtcttgggccacccaagacctactgaagtgggatatgtaacgatgggattcataaaatctatagttacaagccacctgtgtgacttttatacactcacatttgataaccactggaataaggagtggtgtactttgcattaatattccttgcataagatatatatgaagagagaagcctgaagacatgaagttaaagttataaagacataacgtttcgtgaatcaaccattaattttgtttcaagtcccaaaacaagcaggtgtggatatcccagaaattccttgccaagaactggtaacatctgggagtcaacttttaagcagaaagccatccaaggaaaagcagccagctgggaagctaagcagttttactctcattttcgatgtgatatcaacaggtagttctagcacctcaaaaaaagtgatgtgacaacaggaaatacaaacaggactcttgaatccccgagatggaatattcagacatcagcggctgaagctgaggtgctccgactctgtttttgatgtgctttgtcctgagtacaatgaggctacctagcacaaaagagctagggttcattttaataataaacacaactaagagaatggctactttgaagggaggcaggaaccctacattactcctcagacccctcaaatgcaaaaccgcctggagaacattgtttagctaggatcaaaaagtatgttctaatcaaaataaaaaattgatagctgtattttactatcagaaaaaaattaaatatgcacaaatttaaatatacacaaatacatacataccccacctaaactacaaaagcaatcctgaagtaagaatatcccctgtatattgttgacactatctatagttttattctaccagcctacactctttgagtgactttaaaaatgggacatagtttctgctgttggccatcatctctgtccattatttccaacagtgcggcctcttgcacaggtgattgatgattaaactctaggtctttttgttgttgttttatttccaaagtgatttaagtactacctttaatttgtaatagaagacaatcatcaggctctttatggtgcatgtgctaaagactataggtaggccaacttcaattttacatcagtttggtagcctttaccatattcacccactcccaccaaatgcttgtaccctcggatacttagcaacccacaggtgggcacatattctctctacctatgttaggtacatgaatatttcttccccactctggaaatactagagggaaaagagtcagaattttggcacaccacttttcaggagttgctgacccctcatggatagtatattcaatagtccgtgtgagtgtgtattcaggagtaaatataaaatgcacctgacctgtttttcctttatttatgggtgagcaataatgttgaaaacaacaatacattagaacccaagggactaaatttaaaacttaatttagaaataaaatggaaatattttatcaggtctttaatataatttctgaggtccattttttttaatccagaagataattttgcctagaaatttaagttgaatttggttaatatggttacagtcccaagggatacactgtatgacttacccaaacacattcttattgaaggagttacctgataacagatggcacaaatatcattgtgtttctcaagctgctctttcgtagcaatgggtaacgatttaatcttattcacagcatccctgcggagaagaaagctcttccaccccagctgggcccgaagccacacgttatagtaggaatgaatgaagatgatcattgagcccatcactgtccattctccaaagatggtctctgagacgccataggccaccacacagagggccacaagaaactccagcaggcggtaagtgccattcacatagtagatgacatcatccatgttttccactggctcttttctgaattcctcaaccataaataagacataaataaaaagtgttcccagaacctgaaaaaaaaaaaaaaatgtacgtatcttgaaatatgatcactaagatacttttttcataggctttaaacaataacacattcctgatgtttttagggtgcaatatttcaaatatacagaagagtatccaggggaaaaaaaagttttaataaataaaaaatcaactctaaagagaagacactgatgactaaaatgtgggtgatcttagtaatccaggcatagaaaacaaaaagccacaccgtcagacgtgactttcctaaaatgattctgatgagtaatcaattttttgattcatctttttcccttattccttaggtcaccaaacctcatcaactccatcttaattttcctcataccatagtcattcctgttctacaactcgcaaagaagttttacttctgcaaaaaaataatgaataactcttcactgtgttatgttttcctttacctaggtagcaaagatcttcctttaagttacaataagcttatcatttctagggcaatattttgtgtgtgcatgtctgtgaaacatgtatcatgtctgtatgtgtgcaatacacacacatcatatacatatatatttatatacatcgtggaactattggtatttttgagtggaatttaaaaaacacactccaaataagctctaacacaagctctaaaaacttttaatattttagttacttgtcaatttaagatttatatgacacctctgtatcataccattttgaaaaagagaaactgaaaggcttaattaccttcataaaaaatacagtgacatcaataggtttatgtaatattttcttttttttttttttttttttgagacggagtctcgctctgtcgcccaggccggactgcggactgcagtggcgcaatctcggctcactgcaagctccgcttcccgggtttacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtttatgtaatattttcataacctgccatctaactcctgtgctcaaataaatgtaatgtgttctagtaaagagagagagaagttatcacctgaatagtccacttataatcattcatcttgaaaaaatttaattcctcctctgggaggaaaaataacaaaattggttattatatagagttaattaatcataggcttacctgaagagaggtaagaatgctgctggaaataatgataagaagccaaaaatccatgtggaaaaactggcaaatcatataagccatataagcagggaataccaataaaaataaacaaaggcttacagcacggaagtgtttccacaagctcctggagaaagacaaaattattctttttaagtgcctgccacctagtagcacaaccactcacatcagcagctaacatctctggtgccatgatcaaatttcacaaattcccactgaacacccttctccatgccagtcactgtactagagttcagaccaagtcacacaggcttggcatgtcaaagccaccacactcagtcaattgcaaagtacagctgattttcttttgttcctcaatagtttgctttcaattgctactcctagcaatttcaaattatttcaggcttttgtagccttaaaccttaacaatttcaataatttttcctggttaagacagggagggagtattagaataatttgtggtctttttcaaatcttatgacaccctcttcccactgtttccacttgtgatgagaatctctgctacagagagtgcagtgtgactaataggaatgactctccaatgagcaggtatactcatcctcacatctgttgtggtcagggtaagtgggagacatgactgagagcaactgtattgtaagatctactacctggttttcctccctcctccagccctgatctatccaggacactgccagccagactaatcctcctaaagctctactatcgtaatattttcaacactgtctctaaatttttgagcctggcatttgaggtcctccactcctaatttttccatccaagcttgtcaaatctgttcctcataaaccaagctgcttattaactaactgccctctcagcaaaacacaagcactcttacgtcccactagaaattcctccatcatgctctccatttctctaaaccctttaggctagttcaagctaaacaactttggctttcaattgaaataaagctcatggctacaaaaaaatttaagctgttttaattaaacatcaacatctgtgatatgttctcaaatccaagtaaagcatctcaaagagacacaaataacataaatcatctctcctacctttaattataatatagtcaggaagtaaaagttaccacacacaaggtcaaatgctatacagtgtggtcctattataatcagtaattcagagaagaaagttaattattatggtaaaaattaaagctgcatactttggaaagtgttttacattttttcttgccaaaaactaataataataataataataatcagaaattaaggaacaaatgtaaacttgtcagtagctttgctttgagattcagcaattttaactttttaaagaaaggcagtagctgtactgtgttagatgatgaattatagatctaatagggcaatctgccttaaaaccttaaatatattttttaaaaatcaagccagctatgatttatatgaaatatgtacgtatttataaacacacatgcatagatttaagcacacacacagaaatgtatatacaacaatgttatgtcaagagttttacatttatgcctaattttaatacaggtggatatatacacacaaacatatacatagacacacatatatgtccttatctaaatagttaaaattaaataaaagcaaatttcaaataaaatataaaaataagggaaaattacattgaaacctcgtgcaataggttaagtactataaaaatgacaacccatttcctaaaatgtttgccttttgaaaatttgctacataatttgaataagtagaccatagttctaatattccttgttaaaaactgcaataaaatttacagataaaataaccaattatttctatggctaaaactaactcacacatcctcctaagctaaacgtggaaattacctacagttcaagcaactccaaagacgtatttatgaagattttccctttaacaattatttcattaatagaaaagttgtttcatgaactattagtatcatctcttaattgtcctctaacttgagaattaggacgcttttcctttccttttttaattcccagtacactgaattgaattcatcacaatccttgattgacgatgtactgtcatcatttgtctgtgcatgtccctccttttatttagtcagtaatctaattaactattgtcaataatgtaacaagcatttatgaacccacttcccacatacaggtgaaggcctggagaataaaccacatctaacgacaggggcaggcctgcctatatataccatgttctcgcccctctgccccacgaaaccactatcttgaatcctgtgtgcttcattctcttccctgcttccctttttatagtttggttttatctatatgtatttctaagtattacaaattttaaaattttgtttttaacataaaaataatatcctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaaaaaaaataataatatcctacattatcatctttttggatttacttttttacctcgtgctgctatgatcattcatactgatttgtgggtcactatttttaacatagcactgtgactattaccacattttatcatctactttcttgttgcattggcatctgggttgttcccaggattctggtgaggtgaactgttctacgaacattcttctacatgtctcctactgtacacatgcaagagtctttgaatatatacctatgaggagatcatgccaaactctcttccaaagtgactacaccactttacactctcatcagtaccatgggatatcctgtggagctgcaacttcccccatcataggtattggcagattttttccctcccctttctatctccttccttttgattgcatgtaaaacagtatctcactgtagccttcacatttcccttatcatgaatgatgctgaacttctcttcatgtttgcatttttctcttttcctaaatgcctcatcaagttttttgtccctttctcttactgatgtgtaggagcgattcttgatcaggagtgcatactagaaatattttcttccagtttgtaatgaccatttctaacttaaaaactgccattaattctaatattaatcattaaatgtattaatcttttctttcatagtcatagtcaatctcagtcttccacagtcagttctgtcagtttaagaaatcttttcctactcaaaaatatactaatctcagtggaattttaaccttctgtttttgacatttaagtccctaacatactggagttattttgtttataatgcaagataggaatccagtgtttttctagcttcattatagagtagcacctgtctccactcatctggcatgccacttctgtcatataccagagttccacccatatgtgggtcagtctgtggtctctattccactggtctaccttaagccaacattacaaatgcctcgcaatatctcctgccatgagtgaaatactttaaaaattgtctggtttatttcaatattgggattacgatggcttcacagagtggacttggggggtattcctcttatagtttgaaagtatttgttttaaataatctgccaagtgtggtggtgtgcacatgtgtcccagctccacagaaggctgaggcaggaggactgcttgagcccaggagttcgagtccagcctgggcaacatagcgagattccatctctaaaaataaataaataaataaataaataaaatagggataactgttctttggaatttggtagaacttgcctgtaatatcatctggctcaagaagtttgccaactgctttaatttctttaactgttatagaactattcaactttttagttcttgagtcagttgtggtaagtggaatttttctcttaactttatttcatttgttttaaaacatactggcatgtagctgatggttagtctcttattactgtaggcaatggtgggagggaagaacagaatagaatagttcatgtctatttttcctcccacagccaagagggcagcctctcccgcctcaggttaatgcagccgcagccacaaggaataacacagacaccaattcaaagtaccccggcccacatacaacacttctcagtttgctcctttttctctaaatctcctctgcatctaattttggagaaagccagtagtgaggatagttcagtatcctgggaagacccacaactgccatccactgattcttatactagtggaacaacatattttttctcttttctaaatattagttttatcaatatatactaaattaattagtgtaattaataacagatgacattgacagagatgacaaaatactaattgtacttaggtcaaagaaatctacttttcagatctactaagtggctatttaattgcgctcacccttgagttcaacattttaaatgcttcagtcaagaaaccttaaacctcacaaacaaatgtgaaataactaccatcaactatgatgattaagaagatctgaaacatgtctaatagtttgagcttatttaaattgatttttcagccatcctaccacttgagaaaattatatagaatgtttggcaatgtgtgttatggggatacaaagatgaatctgatgtactataattaaaatgttaatttggaatgttttagaaatcagctgatacaattctacctcccaagagattagctgttcccttactataaaaggctaccgaagaagcaataaattcagatgtatttctataatcaataatcagaatgcagatagagaactagaaaaaaaacagtgacatcgaattttaagaaattccttacagaatttccttgtatcaactacaataaaaagactgtatctttaaggaactaaataatagtttggcttttatccctcacaaaaatttctggatacctcaattatcctgatttaatcattatacaatgtatacagctctcaaaatatcacacgaacctcaaaaatatatactactactatgtatcaataaaatatagagagtttaaaattttactgtaatgcaagatgtacatgaatccaactattaatttcatttggtcctataagttgtcaagaatccttataatccagtcagttgaaattgtctaaaactccatcaaatgaggctgtttttccataaatgtctattttatgattacctgatagcctctattttcctctccttcatttgcatttcacttaatgctttctctcctttaattaatttacacagaataaaattaaatattatttgttacatttattatgctagactaaattttatgctctatgttcttaattttaaaattggacaaatataaaaagtattaacttcatctgaagcagaaaaagttaacttataattacatggcctttgatgtcatttttaactaaaaaatcttgagagaaaaaaacaaaagtcaagtaagtcagacatctcatataggaaaaataaaaacataaacttgttgaattaacctaagctaataccaattacccatatccattttctgtctctaaatattccctaaatatttagacaacaaatgcatgtaaagaatattacatgagttaatttaaagaatattaagaggtttcttacttgtctctagatgctcccagtgccaaaacaataggatctgcaatttctaacatagactgtaggatagaagctacgacaatgaaaaggataatactgagcaagaatgcccgatgaacaacctgcagttctatcagcccagtctgcactgccaggattaacagcgttactccttctgtcatgcccctaaaaaaagcatacattttcagaaaacataaaataatctgaatctcatttaattcaaagagaaaaataatccaaaggcttagactcttgttacatatttttaaatctattctgacttaatccagactaaaaacctgatcagtatattaactttgtaacattaatgaaatagtcatatatatcactacatgtgcaaaggcataatagctattactttaccacacaatgagggcaaaaataataacttctaagacaaatagaagttttccaaccagattctgtaaatgagccagatattaacatcaaatactgtatagaaatcagattttaacagggctaaacttcaaatgggaaaaagcacgcttctgaaaatctcttaaagaaatctagggaaggaaggtgcccaatattcatcataatgtattaatacatacaatacaaatacatctttaacatggaaatgtattttttcatagtattttaacccaaatgttgcaaccattcaaaaaaaacctctccaattccatttcttctaaaattcatcagccaaagaaattcatcattacttcctcaagttatctatagtatttacatttctagatataatcaaggaaagaacttaccgattcatggcaggatcattcatgaaagctcgataaccctgcaagtaaaacttgcagagtgtgagaacacccaaggcaacaaaagaaaccgtgaagaccaaacccaaaagagagtaaggagtgctgcagcattccgcaatactggaaaaaaagagggggaaattaacagacataaactttccatttggagtaaacacatttgaggcctttaaataatcaccaagcttgatttgatactcattaattaaaacatcctaaaccaaaatttgaggagaaatcacccaattactccattaataatttaaccatcttattcaccttcaaacccacatttttctatctcattggcaaatatgcagtacatagcaccagatctgaaacaaggtcttcaaatacagtaaaattcaaagagcctaaatgttcacatcttaagaaatatataattagcatgctgacaagtattcaaaagaagcttgtacagttgcccactcttcttcctgaaaaatgatggctgttcaaattgttcactgtgctacattataatatgaatacttgctgcaactccttatttgaccaaactgctatggagcagggtgtatcactcctcctactccatcagtatcttacatactactgctatttttaaatttaggttgagacaaaggcattttttaaaaaagggttacttcaaaagcatgcccaataatttgctccaagactattgaaaagtaattttaatattaatttttaacaaaagtttgctatgatactattcataaggataactggaagacattacactagaacttggaaatattttcattgaacttcttagatattaacttatatgtattttataaatacatgtactattatgtactgagatagatttagcatttacacaatatctatcttatatatacgtatatttatttgagacagggtcttgctctgttgctaggctgaagagcactggtacaatcataactcactgcagccttgaacttcagggcaaaagcaatcctctcacttcagcctcccaagtagctaagaccgtaagagcgtgccactgcgcctggctaatttattctttatacagacaaggtcttgctatgttgcccaaactgggctaaaactttctgcctcaagcgatcctcccacctcggcctcccaacgtattgggattacaggcttgagctaatgctcccagcccttatatagtatctacatcttaagctttaattttcaaagaagaatttcactgatatagatgaggaattcattcaggcaatcaatgcttgtcccttactatgcagctccatgcttctatatagttatctttcctacacaattgcttattagttggtttttatgtgaaagcatctaattttacatggtaccaatgtacactatgatgagaaaaaaagtctggttttctgttaggagccaaaatatccaccaatcatggtggctaataactagaaaaaaataattaattttatgacattcctacaaatttaatttctgaaatgtttggcattttcacactgaaatcattagtaacaattttaaacaaattgtgtacaattttacaacatgagaatcatggctgaaaaccaactaaaattttacttcattcttattgaaaaaggctgaaaatttaaccaaaggtccatactatttctctatttttacggacctttctccatatttagaaacattttttacacccacacaatatgatttaattacgtattcaaacagagcactttccttttctcttattttagaaaaaaaaatgtggtgctatttttcaaaacagagcatactaaataccaaagatttcgacctagctttggggaagtgaaagagtttggaaaatttataaagtttttctttgctctctcttcattcagtaactcatttttattaaatcttaatttctattttctggctgcaaaaaaaaccttttttttgatttgcagtttgatctggtgtgctttattgttggttggtgtgtttgtttagtcagggtattctggtaagctcccaatctctttttctaaataagttgtttttttggcaaagaaacataaacattaccaggcacacaaaagcatggataagaacagagaataactcttacagagatataaattaacaaaagaaccaatatgagaacttctcaaagcaaattacaacattcttatcatgaaaaaaggcaatctatcctggcgaggcatagaaaaagaaaagaaaaaaattatgttagcaagatatctaaacttcacagaatatccgaatattattttcttactttgtaaataagtccaaatgcattcatggcttagtaaattgttaagcctactgcactatgctatacctcatcttactgtgctttgcagcgggtaacaatctggtttaaagcaccaccaattcagtctcacgctgagtttattatcctaaccacagaactgtctctctttctctctatatgcagttactttttgggtcattttaaaagtcttcaggccgggcgtggtggttcacacctgtaatcccaggactttgagaggctgaggtgggtggatcacctgaggtcaggagttcaagatgagcctggccaacatggtctctactaataatataaaaattagccaggtgtggtggcgcatgcctgtaatcccaactacttgggaggctgaggcaggagaattgctggaacctgggaggcggaggttgcagtgagccgagattgtgccactgtactccagctgggcgacggagccagattccgtctcaaaaaaaaaaaagtctgcataaaacctccataatacttatatcaaaaacaaatagcagtcaaatttacttaatactagattaatcgttaaaatgtatttgaatttgacatcaacttactgcatgtttatagaagctacttataattgttattcatttttagaaagttcaaaatctgattcagtaccagtataagtttatcccacttatttcttaaaacaggtttttgtcctgtatatttttaatatttacatttgtgttaatgctttcctagtaacatgctccttaaggatagtaaacttgtcttaaatttctcatagcctacaccacttagtacacagtcttccatcatattggatggctgagaaacaatgactattaactagaacttaaaactgttatctacctatatttactttataggaggacagattttcatccctactttttaaagtgacaatgagcaagggaaccaagatgtatattcatgtactagattctgagaatgtgagattcaaactcaagagtggaaaaaataacaaatgtggatctagcagaagctcacaataaaatgggaaaatgacttaaatgacatgagatttaaaaagacaaaacaaaacaaaaacccctaaatattaaaaaccgagtcttagaattattttgggttagtccaagcttgactaacctgcagcccaggacagctttgaatgcagcccaacaaaaatttgtaaactttcttacaacactatgagattttttttttgcaagtttttttttaaagctcatcagctatcgttagtgctagtgtattttatgtatagcccaagacaattcttcttccaatgtggcccaggaaagccgaaagattgaacacccctgggttagacagtaaagtactattatctacccatttcaccaattaccggactctttctcgatactgaagtcaacagggacaaaggcaaagtatagagagtaagtcacaggcttcgaactcaggtgggtctgagtgccagttctgcttcttttggcagtgttacctggggcaagttattcctggtacagtttcttcagctataaaatggtaattataataaaggcacctatctcttagggtcgttgtaaagattaatgtgaggcaaagtgtttaatggtatggtacattttaaatactcaataaatgttatttttataatatacttttttctgattgacccaataattttaacttgaaattgaaaaaatacttttacgatttgctatgtacctttccacaaatcatttgctacactctggtccatagtgcagccaaataaaccacattattatgttagcacctccctgcattgccaaacctaggtatccagtgaatgaaaatcctatcttaacaaaatacgaagttgtgtaacatgaacgataaaagtaatctgcaaaacttactattcctagatcaaagttttctctttctaaggttatatatagtatcataggctcttattaattaccttgtcagaaaaaggaaaagaagcctctcacgtgatgcaggctgatctcgagtactgaaataggagtaaatctgaagagcaaataagacgagccagaaaaccatgaaaagaacagggactaccagttgattccacagggacattcccaaggcgagaaggccatatacctccactacctaaataaaaacgtaagataggaaaacttcttgcatcaccatcaataaacactttaaacacttgagtcaaatcagaagtaaaatattaaatagcttttctttgattgcaagactgtttcagctaaattcctttaaagttagcctatatagttaataaatagcatgttttttaaaacttactaattttgcattattattaacacttgacacacacttatctaatagcacagtaaactgccctaatagttcagggataaggtcaaaataaggtcatattcagtacaaaataaccttaaaaggtagtttgaggagacttggtaaacactcatgtctaatcaaaataatcaggactagcatgaattgatacaacactgcttgaggcactaggaaaaaaaatgcaaaagtaaaaactttcagggtttattcagaaatgtcacaaatgagaaacagttcaatggaagaagagtacttaatcactggaaaaaaattttgcagagcaaagatagttagcaagtctttttctcccatacacatcaattccccttcctcctactgtgtttttatcaagctatgtttttccatttggtttgccaagtgtaagtaacactaggaaaaggatatatcttaaaaaaaaaaaaggcttaataatctgcaactcactaaattagttttccagtttataaaacactcttcttatgaaactgattaggaaaaatcaatcacagaatctgattcaatctaagagcataggtgtaaccaagtttctagagttactatgtcagggaccagaccctggtgacacagcaggaattctgctggacagcttacaaaaccagtatctagcagtcagctggtcttgctggaatctctcaatgtgataccagaatgtttcaataaggtataaacatctttaagtattaagttaaaataaattgacttgcagattattctaaatttaaaattctttcatcagtaaagcaaaggctttttctacaacccagtctattaacttctattttccccagtgacaaaagattaaaagaaaaaggaaactgcccaactagctgcaaaattattatcaggtaaactcatcattacgaggcagagaatatttttcttcctttccattcaagaaacagaccactaaaaaaacctgtctgtttccatttcttgcttatctgattctttcctggtcacgcattttataacctatatttccaacaactacatctagttgatgtatgaatcttatggcaaccaactaaacatgacattaaaaaatgaaggctgaggttattcaataaatatttaatattcaataagtatttactgaatattcattatttattacaaacaaagataaccctcataagactgaattcaaagaaaaaatatgtatcttaaatttgtcattattaccctgaatacaactataacccttcctgccctgcttccccatgaagccactcttcactgactgtagaaataatcccttttctggaagatctactcctgggaaaactgcccaagttaatcactgtgtaagacgaagatagaatcaggctaaggccaaaagcttagagaaagtattctcaaagatctgcccctggggccacaagagaatacttcacttagctgttatcagtttgttctatctgagagcttcctgtaccttaaggacacagtcaagaggtggaagacagtgacattttaacactctctttttataccaatgtcaggttaaaatctattttatatattacaaactatcaattaaaccaaacagaaacatttatttcccaaatgtgtattgtttgtatctgggagtaatttatcttagagcaaaggctgaaaaaagtagggaagaaacttttacaaaaagcatgttatgttggcaaagtcaattcaagtactatatctaaatgaaatctatcatattataacccagaactatttaacttttctgtttaaattaggcacacaaagggaagaaactatagtcacagtaggactataatcagaaggaaaaagcaggatttgacttataggtattcaattctttattatttttgtcttcattacaatagctaacacatatggaacattgtctgcctggtactaaactcatttaaatctcacagaactctatgaggaaagcacagctttcattattagctccgttttacagaaagtaacgcaattatcacaaggttacacagctagtgaacagcagcatcagggttcgatctcagataaatctgctttaagagaaccacttcactttactgccttctcaatagaacataatcaagaatctttcagatgctcctaattgggctgaaaatagcagctgttttgaaactgcaaaaatgaatggtaccataactgtgaaataaaaatgaactataactttaatgtacttaacatttatgtagaattttatctacctgtttgtggttgtcagcagtcttacctgaaccaattctctgtatgcagatttagcaaggttataaggtaccaaaagattagacccaagaaaatagagaacttccaatccagtaaaaatcatagcaaatttattgatgataacaattgtctccaaaggaacaaggcagagtcgtgctagcagaggaagcatgtgagctgaaaacagccaaatctgctttgttttcatgacacaggagcataaagtacacaccaccaactgacctaaaatagggaatagaatacatttaattttgagtatttggcatccacaaaataaaaacaaacaaaaaacactgttgataaggataataacacaacttttgaagaagtctaactaaaatctcgtagataatattttaaatcaaacttaaacttcatctgactataattacatattcacatgttctgtgaattttgaatactaattctgtagggctgatctggaaagagcagcataaatctccactggtcgtctgtgatgccatgtgtaatatgaagaaaactttaaacaatgtctaattcagtattgtgacaattcagttgctaatgtttatacataacttcttttccaaaggtacgcaatatttaactgttctggtctataggtgaaagcataaaatccaagagatataattacttgttcaagatcatactgcaacaatatttgttctgataattttttaatctttatttttggagggccaagtaaactgccccaaataactaaatcataagttaaaactaaaaactaaataaattcttctcactggggattacgcatgatcattacattaaacacagaaatacaaagaacaaaatgggaaactctcagtctcttataatcccacaacccaaaggtagtcctaagaacaccctggggtacactgaatgtatgtgacatgatatttgcatttagccctttccaaatattccataattataaaatgctttgtatgaataagcttttacattatgacatccttgtataaactacttggaacacatttcctaatattctcttaggctaggaattactgaatcagaaaaaaacatttttaaagactttgacacactgtcaagactgccctccagcaacaatttaccagtgtataatgtggctatttttctattaacttgccatagtgagtataatttagagatgggaagaacagggaatatttcccaaattttttaaattggcattttgttggttactaacagcactgaacattatcaataagtatatgaaaacatttgcaattatttggtgaaatgttcacattctttgcccatttttctgctagaatacgtatcctactgcctgatcgaaatagtaatccttagtcacatgattgcatttttctaatatgtcccttgtcttaatattttaaataactttattctcttataaaagtatgtattgaaaatagtcaaaccattttttttcttaatagtacccacctttagtgccatggcttattacatggctaccccactcaagattatacaaatagctgtattttcttttagtaatttttagctaatttttaattttaacttaaaaattaatacatttgatttattgtggaataagaaaataaagatcgaagtttgttttttgtacatgtttagctggttatctcaaaactggctactggaatcatccattcctttctcattaatttgaaatgccactgtagtaaactccaaaatcttttacatatttaggtctatataagaacttgttactttttgttttcagtgatctattctaatgatggtaccaccctgctccatcatactgattggacaagtcctctctcattgctcctttcagaatttcttggagattactgaatgttattttccagattaatttagaataattaatcatattctctcacttcttgtcaatgaaaaccaaaatgaaaatttgggacttgtttgtattctatccatatacatgttgaatattcctaatccaaaaatctaaaatccaaaatgccctaaaatctaacattatgctccaagaaaatgcttattggagtattttggatttcagattttgggattaaggatttccaaacagtaatataatgcagatattccaaaatgtaaaaaaatcagaaatccaaaacacttctggtgccaagcattttgaataaggaaaattcaatttgtgttagaaaaatacaaaaatgtcaaccatttttacataagaccaaacacttacaacaatctactatgtcataaacacatacggtattttatctcacaaagcattaattttggcctttaaaaaactgatactaaagtaatgtgaaaaataatcataaaggcataaagaaaagaaaaactcctaattatatagaaaacaagaggccaccaaatgatctggctttcactgtgtttatagctatgaaatttaaatgtccttgttgagcacaatgtaaacttcctctaagctctgaaaattcccttaagtctatgccagcacatgtggtgctcagtgctggggttacaggctccctttatcttctttcatagaagaatatgactcatatggcgtatttaagagaagactactcctgctgacgtaaaagaaggaaggagtcatattgttagtggaatttcccctgaagttccaaaagaataagttgtttgtcttctgatttgcctatttcaacttttaactctgcataaaccaaaatcccaatgtactctttagatttcaggattccactattagaaatatctccaagaggttggcaaccctaagaaatcatggcatattaaaattacctagtttttcaaaaaagtttgttactgaaatgaagaaaaacaccagaaaattattttaaaatctaagttggaagaaaacatgctccttaatagtttatggactttggaaagttgaatcttagttaagtaaacagaagaccatggccactgataagaagagttttaagaaatatgcttcatatttataatacaagtatatgcatcataaactaaaactttacaagctttctaacttggcaaatatcttcattattgaatgttaccgttaataaatatgccaactcataacgatagtcataaagcaacattatttttgtcctctgctgtcttttaaaatccactctgtagagattagtggttttcctgcccctagataaaatccaaggcaagtcccataacttttctactctagcttaggttactgtctcaatttaataataactgaaactttcaaacagatttaaagttgagacttatcccttactctagagttcaggcattctagggaaagcattaatttttacctttatgctttaagatagaaaacctgcaagtgggagagaaggtggggaggttgtggctggcttctttctcttttttgacctagcacttctccctctctctctgacttaccaaggattgaagtgggtagggaagaaggagagggagggaagtaggcaggttcctacttaactggactcttacaatgatgtggttgttactggtgcttcctagacttgaggtatctaaaactgatttattttcccctggacccttttatgggttcttctgaaaccgttcctatcactgtggctctctcacctgcagcagtacccttggtgcttggtatacaccctcaactggccatttttggctcttttctcagctcctgggaatctggaaggtcaatccctgttgaggtcttctcatccatctaaaaggccttcttgaacaggacccaagaaaatcctacacagactttcggggccactgtctagttcacaagaaacttacatcctttgctctacaatttcctgtatcagaagatacaggaaaaccctataaggcattttcattccacagtcaaaacactcaacaagcaactagtctattgctagtcctttatatcagattagaattataatgtaagccaaatataattttaaattttctattagtgtcatttcaaaaagtaaaaagaaacaagtgaaatcaacaatatattttatataacctaacatatcctaaacatcatcatatagacattcaatctatattaaaagttaacaagatgtattaaaagttaacctggtttgtaccaagtcttcaaaattgagtatgtgctttacacatacagcacaccttaatctcaattcaccacactgcaagtgctaaccagccacatgtggctagttttggacaatgtagttttagattttgcaggctgaaaaggcacaagaatgatatagtggaattctggcctcctggaaaggtgagaggtgggtgaaggataaaagactgcacattgggtacagcatacactcctcaggcgacggatgcaccaaaatatcagaaatcactgctaaagagcttgtccatgtaaccaaacaccatgtgttcccccagaaacttatctaaaaaatgttttcccagcctgggcgacagagcaagactctgtctcaaaaaaaaaaaaaaagttttttaatgtaagaaaataaaaataaaagtgtaactcaaaaaaaaaagatgttccagggtgagtcagacaccagtccacagcattccccccttcaccacacaagacacataactccccaaatggtcccccagtgaatcctctagtgtaaagggctggggaagtatttcagaaaaaaagagttctctctgaagaaatcctcctctaatctctaatattaggcctgttaacaccttctacatgggtgagtttcaaagtcacaaaacaggttttctcttacttccttttttgcattttggcatggtacactctggtagcaggggtctggtacttcactttaaattgtatctatattgtttttaggccttagccaacacttctatttttaacattctgctacctgaatatttcaatcacatctcaagttcttgatgtttccggacattcatttttgacaataaggtcatggctttcaacagcaataagtaaatttaagatactacgtgtttcattttaatctttcaaagtaataattagctctatttaaaaattaatcttctcaaatacttaaaaaacccttaaaaaaacacaagcaactgtgcactatgtacaatatgactataaatacataatctatacatggggaaaagaagacttaaaaaaaaaaaaccaccaaacaatgggtatatgtgggaaaagtccccatgaatcacttttgagaattccgttttaaaaaaaaatgagtatgcatgaattttataagttagtaagactggtcggttcctacctacactttaattcttttataatacttacctattaaggctgtggtaaaccgattcatagagagaggttctaaatacattggtccctcataggcaaactccagttcactccgaacatagtccctaaataagaaaattgattagaatgtatatattagatacattcctagcggaatcacaatatgcttataaaagcatattatgttaatgatacccctttccatatctaaggaaaaatttagatatgaagaattatatataaatggccttcatctctgttttctgtgcactagaaacagacacaacttattgaaatggaattttaccatacagagaaagctgccaaagctccacattatgaaattttctttcttttcatggccttattaaatattttatgcccagtaaaaacccaattgagagctgatctctctcaactctactacactaaccaatcacatctagtgatattacactaaacatctcttttggctatcttccaccaccatcaccccaccctcatcttatttccctcaaagttttggccccgattatattttattagtcccaagtagaaccacaaactagttagaaaactgggggataggagtacaacccttaaaaattatcattttcaactctatatgaaatctaagataattataatatttaagtaggctacatatttactttgaagcaaattttacatcaaacaaaatattccttttaaaatttaactcatttaacgtgtgactactgagaaatagtaagctttaagtaataaccagagcctttacacactcagaaaacaggcaggaagcacaaccagggagaatttagtttattatcagtaagttacatgggagtactggaagacagtttgtctaaagtatttttggcatcaaagaagggaagtttgtgtaaaaaaattcttccctttttttcaacttttaatgctttattcattgtatttaaaagagaacatttcaagtatttccaaacaaactcatatggctgtatttactttttccatgaaatgacttcccattaggcaatcaagtggaattcctttagcactgcatagccaaacaaggaaagaccctcacacaatcagccggaagggtatttgcaaaaaagaatcaaaacttaaaactaaaaattgttaaaagaattaaaacagtttctgagattataaaaatgcatgactaagttatatgggtgatctagcaattctcctttatcactcttagatgatggtttctaacacataatgtattaattgtctctttctactgaaagaggaagccaaattctcaggaagaattattgtaatgcagtggttgtcaaccaaggggcaattttgctcctgaggggatattctacaacctctggaaacatttttggttgtcacaattggggagaggtattactagcacctagtgtgtaaaggccaaagatgctgctaaatattcgtcaatgcaaaggctagcccctagaacaaaaaatcatccagtccaaaatgtcaactgtgcaatattgagtaaccctgttttcatgtagaaagacacaaatgcaaataacacataaatatctgattactataggtaaccatcaatggaattatatagttagaaaactaaaaaattaaaagaattatgaaattagaacaaaatgcatatataaatagtattaatacaaagtattttaaaatgctatttgaaaaataaatttatacctaaaagagatacaactctgagtgtcagtactatccagacctttaaagcccaataatttctttttggtcatagcatatctctctccaatggatacagtttaaacaggggccaggaaaaatccatacagacaaaacacagattggtggttgccaggggctggggagaaggggagatgagagtaacggcttaatgagtactgagttttgttttgggtgacaaaaatgttttagaattagataaaggtgacagctgcacaacattatgaatgtactatatgccactgaactgctcactttaaaatgattaattttatgttatacgaattttacattagaaaagggagagaggtcagctccaagagcactatccccaaggagaaagccacaaagtgccccagaagggcctcagtcccaagtgtctctttgtgagggacaagaaaagacagaagaattgaggtccctaccatgttttctttccactgtttggttttgtcacatattattgatattttataataaagctcagcaaactaaacattatgctagaatttgattgctgagacatttgttaattgttctgcattttttcatagcctacgttagtttatcctctttttaaaaactttgtctttctttagagtttcttaccttaaattctaatttcacacaacaaaatttctagggataactaacattctctgttgctttttaactcaaaaagaaattactgaatacataagtgctggcactctgctagactctgctaatactgcacattccatactagcacgcaacttataaacagggaggggagataaatacttagtcctataattatttaattatgatgatgatcagtgctgtaagaaaaaatacagaatgctgtgaggattttaacgtcttttttattgatacataaaaagattttaaattcacagcatatttaaaaactacatcttttattctctatttctaggttctaactttttcatttaactaataatatttctatctgccttttacttttttatcttaaatactacttattttacttctcctatttcatatggttattataaaaggttttaactatttccttttcttttatccaaccctatatttcattccttttttaagccttctcttaactttgtaatcctttccattattttctttttaattatttttgctttctctatactcattactttgcgatttgctgtgattataggaccctaagggaggtctgcattccagaagaataaatgatcaacctttaggccacaatgacagccctgatgttaagtggtttcctcccactcgctctccttactttgtcctcctctaggatcccaggattagctctccaatactgtactgccccccacattcctgttcaatttaagtctgtatcattcatcatagcctcaaaattagtatcatccctaggccccttagaacgtttcccctttgctcgattcctctctttcaatacagtcctccaaaatcctccatttggctgactcaccaaaaagccccacctcagtaaaaacagccaggcctagaaagcctgcagactctctctttaggccagctcagcttagcatgccagagtcaaggcagtagttttggtgacagctaaactacctagtatgccacacaaccactatggagctgtcacttctaaaaggaggatctgggcatcccatcccaaactgtagagaataactgaaataagaatcagggttaacaaaaatctctatatcttacttatgcacaaattccaggtatctcatgctggcattgagaattcttggtaaatcagtcctaacagggatggtcattcacaacataagaaaaacaagacagtaagcctaaataagaaggatccaaagtgggaattatccaaaattccatgagtcattttaggtgaaaaattagttcaaggcaagagtcataaaattctaacttttaacaacaacatatgattctcttaagactcaggtgagctattcaagagaagcattacaatttttcatttcagaagacttaaaaggtagaatgttttaatatcttcagaaacaagaattcctgccaatctacttataactgaataaaatattttccttcttaaatgttttttcacttgtggaaggctgataatcaccccaaggcactaataaactgaaaaatctacgtccctagtcctgtataacagcctcccctcttttaactcaaactggggccacaaggaatgtacaagatctatgaaaagggcctccggccatggtagctcaagcctgtaatcccagcactttgggaggccgaggcagacggctcacttgagcccaggagttcgagagcagcctggacaacacggtgaaactccgactctacaaaacaaaaaatacaacaattagccaggcgtggtaatgcctatagtcccggctacttgggaggctgaggcgggagaattgtgtggacctggtaggggcaggggttgcagtgagccaagattgcaccactgcactccagcctgggtcagagtgagaccctgtctcaaaaaagaaagaaagaaagaaaaagaaaagggcctcagagcttgcaattagaaaaattcttgcttataaagagaagtatacatgttacaaaaaataaatgggtaccaagaacaaaacctagtagcttaccacttcagctaattaaagacctttattataacagtctcttcagcgacctgactcagacactggacaacctaggaacaacttgtacattctggctatttacttaaagctttcaaacaacgttaattccaaagaaacctaacctgttttcacacaaaagaggtgtgccaagttatcttttgcaatatgggcaacaagaagcaccacttggtacaagaaatctcagatgttcaaatacctgtatttccttatatgcctactaaacacacatatacgcacacaaacatacctaccataccgtcagcactgagctagcagttgaataattcatttacccagagtttatttaaactgttgacaccctttctttagtttctttctggcctcctagatattgagtgcctgtatttgataatgttcaaaagcagaacacatgtcaaacagtgaaactggtcaattttattcctgtcaaaattaagtttagaatataaatggtaatactcattttaacaatccaagctacttgggaggctgaggcaggagaatcacttgagccctggaggcggaggttgcagtgagccaagattgcaccattgcactccagcctgggcaacagagcaagactccgtctcaaaacaaaaacaaaacagttgggcgtggtagctcatgcctgtaatcccagcactttgggaggccaaggtgggcggatcacctgaggtcaggagttcaagaacagcctggccaacatggtgaaagcctgtctatactaaaaatacaaaaaattagccaggcgtggtggtgggcacctgtaatcccagctatttgggaggctgaggcaggagaatcacttgaacccaggaggtggaggttgcagtgagccaagatcacgccattgcactccagcctgggcaacaagagcaaaactccatctcaaaaaacaaacaaacaaaaaacaatttatctagtttttttttttaaagaaaaaaaatttttttttgagatagtctcacactgttgcctgggctggagtggaatggcacgatctcagctcactgcaacctctgccttccaggttcaagcgattctcctgcctcagtatcctgagtagcttagattataggtgcctgccaccatgcccggctaattttttgtatttttagtagatacggggtttcactatgttggccaggctggtctcgaatgcctgaccttgtgattcacccgcctcagcctcccaaagtgctgggactacaggcgtgtgccaccactcccggcctatctatagtagttcttaactgaggacagttttgttcctcagagacagcatgtgacaatgtctagggacactttttggttgtcatatttgctgggaagagggtatcactggggtctagtgggtagacagagtgttgtcaacatcctataatgcacaggacagcttccgtagcaatgcataccctgcccaaaatactagtatccctgagaaagagcagccccaatctacaactttgaattatgcaagtcatcataaaatggagagctgattatccatagtttacacataagtcactcttggggaagtttttacatttgaaaccgtacttacacaccgaagagccagaatgaaaacagtattacttccttcttttgaaagccagttctactgggctcttaattcaagtcacagacacacaaatccaatatgttggttcataaatctaacaataaaacaaggaatttaagaacactgggccaggcacagtggctcatgcctgttatcccagcactttggaaggccaaggcgggcggatcacaaggtcaggagactgagaccatcctggctaacatggtgaaaccccatctctactaaaaaaaaaatacaaaaaattagctgggcatggtggcaggcgcctgtagtcccagctactcgggaggctgaggcaggagaatggcgtgaacccaggaggcggagcttgcagtgagccatgagccgaaatcgtgccactgcactccagcctgggcaacagagcaagactctgtctcaaaaaaaaaaaaaagaaatactggagtttagaaattttagaaaaaacatccatctgtggatgtgaccacaccctcacaggaatgaccaccacactctcacaggaatagtagtatcagtgtatggtttttcttttttcccccttagttttggatagtctcaattttctatacggattagcactagaaaaatacattccctacatccctcaaaacgccaaggaagagtttagtaattttaaaaattttaaactgacatttaccaaattctgttaagttcaattagaatatcaatattaaatatttatatgacattgactgaacccatgaatctctgacatttaattcttccaaactgcaagctatatccattctatagacatattctaaacaagtttttagtcatttcaggataataagtttcattatgtaaatacacataaaggaaaacagaaacccaacttttcaaaagttcatgaaattttcaacttagaaaattaatatttgcaaatgtctttttctataagctagtttttaattttttttttcttgtttccaataaggctggatatagccagttttttaagtacgaaattaattgttaaaattattataagtgctgattctccttctcaggagcataataaactatgccttgatataactagattgcagtgaatggaagaatatatttgtaaattatagatctgataagggacttgtatatatttgcaaatcatagatctgataagggacttgtatatatttgcaaatcatagatctgataagggacttgtatatatttgcaaatcatagatctgataagggacttgtatctagaatatataaagaactcctacaacttagcaagaaaaagacaaataacccaattaaatactgagcaaaggatgtgaataaacatttttccaatatttacacacggtcaatgaacacatgtaaagatgtttaacttcattagccatcagggaaatgcaaatctaaagcacaatgaaatacctcttcacactcactgtaatggctccactaaaaaggacaacaatggatgctggcaagaatgtagacaaattggaagcctcatacaccgctggtagaaatatgaaacactgcagccattttaacagtctggcagtttctcaaaaggttaaatataggcaccacatgattcagcaattccactccgaggtatttgtccaaggaaaataaaacatttgtctacacaaaacctgtacatgaattgtcataacattattcataatagctaaaacatagaaacaatccaagcgtccatcaaaagataattggatgtataaacaaaatgtgacatacatccatacaatggaatatggacagaaaaagaaagtaagcaccaacacatgctgcaacatgcatgaatcttgaaaacatgctaagtgaaattcagtgcatataaaatatccagaacaggtcaataaaaaaagacaggtgatagactgacagttgccaagggctgggggcagggagggtggtgggaaatagacaatgattgctaatgggtatgaagtttctttctggggtgatgaaaatctaaaataaattttgatgatgttctgcacaactctgtgaatgtactacaaaccactgagctgtatacatatatacagcttgttctgtcaaacagggtcttgttctgtcaccaggctggagtgcagtggcacaatcccagctcactgtagcctcaacctcccaggctcaatcgatcctccacctcagcctccgaagtagctgggactaaaagtgcatgccaccacacccagttaattttttgtagagaaggggtttcaccatgttgcccaggctggtctccaactcttgagctcaagcaatccgcctgccttggcctcccaaaatgctgggattacaagtgtgagccaccatacaaggcccttgagctatatactttaatcaggtatgtgactatctcgataaagttgttatttaaaaaaaaatacctggggccaggcacagtgactcatacctgtaatcccaaagctttgggaggctgaggcaggaggatatcttgagggcaggagttcaagatcagtctgggcaacacagcaagaaacccatctctacaaaaaaatatttttttaattagctaggcatggtggcgtacacctgtagtcccagctattcaagaggctgaggtgggagaagtgcttgagttcaaggctacagtgagcaatgactgcaccactccactgcaaccttggtgacacagtgacaaccatctcaaaaaaaaaaaaaaaaaaaaagatacttggttatgaagctccacagaaatctgaaccattatttttttaaaactaaaaccttcaacctcaatgtcttacaaatgttacatattcaaacattggtatttattaactgtgatatgttatgaataattcaaggacagcacatctttactagccttttgtgagatactatcatatagtataaattatactaagaggaaaatattaatactaaaatatgccatatcttgaaattcattcattttatatcaaaacaaactccatgagatggcattgtctacaaaggggtatccaatctttcggtttccctgagcctaactggaagaagaagaactgtcttgggccacacataaaacacacaatagctgatgagcaaaaaaaaaaaaaaaaggcaaaaaatatctcatgttttaagaaagttcacgaatttttgttgggctgcattcaaagccatcctgggccacacgcagcccaggagttggacaagcttagtctacaatttcaaagaagtaacttgctgaggtaacatatttactaggtaaggaaacaatttgtatcaagtctgattctaaagttaattttcctttctactaaccatgctgcctacctaagtggaatgaactagattgtgaaaacatggattcaagttaaagtctgggattgcccttcctagctgtttgcctacttcctttttttcatctgtaaatcccaaaggaacataaaaaaaatcaaaatgaaataagaatgggaagtatttttgcctactataaaattttattaaaacttaataaaatcctattattgaggctggacacgatggttcgtgcctgtaatctcagcactttgggaggccaaggtgggaagatcacgaggtcaggagttcaagaccagcctggccaacatggtaaaaccccatctctactaaaaatacaaaaaattagctgggcatggtggcgcatgcctgtagtcccagctactcaggaggctgaggcaggagaatcacttgagcctgggaggcagaggttgcagtgagccgagataaaataaaaataaataaaacaaaattctattatttaaaataagctttaatttcctagttatgaaaataaacttgaaacattagaaaaagtcattttcataaactgaaactaaaaagctcaaaaagccacaagggtggtcagaaaaaatcctttctttacctctgaaactacttaggtcccctttttccttatataccagaatcctgacctctctagaaatgcctggattggtaatacagtcagccctccatattcactgggttccacatctgtggattcaaccaaccaagaatcgaaaatattcagaaaaaaaaaaaaactgcaattggagtaaacatgtacagactttttttgtcatttttccctgaagaatatagtataaaaactatttacatagcatttgcattgtattaggtattataataatccagagatgaattaaagtacatggaagggagtgtgcaaaagttgcatgcaaatactatcagtatttgagcatccacagattttggtatcctcaggaggtcctagaatcaaactctcatgataccaagggagcatagcactgtagataaaaacagaactacatgggtttagccatcactacaccacaaatgcaaatggaaatggaaaaaccatgagaaagggcaggctcacagtttttcacccagaattgtagctataataaaagcaacaatattaagaggtctaccttcaaccttgatattttcttaattaatcaacaaaatcctatcaattctaaaaagatattatatggctatacataaaataccatgtaaaaatcattttttaaagattaacaatgagaaaatgctcacaaaacattgctatgtgataaaaacaagacaaaagaattcaccaagtactcactatgtcagaaactgtggtaagagctttatataccttatcttatttgatcttacaacagccccttaagatattttattaccactttaatgtgaaaaaactaaggcttatccttctgggaaatgacacccaaggttatggagcagtaaataaaaaacctggaatttgaacctatccaaaccatccatctatcgaaaaataagtgcccaggcactcatttataaaatagaacagttactccagagctcagtataccctaatgactgcattacactctatagatacaatttttgtttacaaaagagtaagcaaagatgggaaagtgtctccatcctcagcctgagctgagactcagaggtatcggggtaaggccacaggaacagaggtgtgggggctggtggtactaggatgagaaacgcatcatgtctgtatcagtattggtgcttggactcctagtttggctctatggagagggatgctacaggacaaggtctaagttgttttcatgaaggagtctaagacacagtgacatacttctgtcatgcaaaacggggaatgtcactgtctccattcttgaagggaacacagcttgatttaaacattgtgaggattgcaagaaatgcaacactactctgccagctccagattttgcaactttgacatcagaggacctaccctgggcaggatggtggcagaagttaaagagtaagacaccatcctccaggcaccattttgagcatagaaaatcaaccaggaaggaataaaggaggaaaatgcaagaagagtaagcttctgggaaacaccctgggactttgagaaacaattagacaaaacattaaagagaattggtggtcctgtttcaacaagaggggtgaaaaacccagtgattttagttattctcatcctttcatatccacagaagtggtgagaattgaacagtattttaaaaactgaaataaagtaccagaatattaacacatctatctctgggtggtataatttcaaacgattattaaatgcctttacattttctgtattttccaaaaattgtccatagtgagcaccataattttataatcagaaaaagttaatgtttttaaaaactcaacaatgtaattctaataatgtaaaaatgctacttctaagattaaatttcaactaccccaaaatctgtttcagactcttattatggcttgtactatatgcaaggtcactcctcttagaattgggaatatattttaatatggtaaatgcctttctatcaaaaatcataaaatttaagtttcaaaagaaattatacctccaaaatatattccaacccactacttcatagtgtaacttttggtccacctatattttaacattctgttgcaaagtagaaagctcatattcattggcagacccaagtcttaaaatttagatctagcagacttaggtacacagacaatatggctaaagagatagaaggttagctatacaatcaaccttacaagataatgtatatcaatcattcactccacatggctgcatcttatgctgattcttacacatcataaattgatttcctaaagtaatgaagtctataattgttaaaatgctcctacagcctacttttagaaattcttttatcaggcaatacaggaaagttcaaggatatcctcccgagtagatgggattacaggcgcccgccaccatgcccggctaatttttgtatttttagtagagacgaggtttcaccatgttggccaggctggtcccgaactcctgacctgaggtgatccacccgcctcccaaagcgctgggattacaggtgtgagccaccacgcccagccagttcaaggatatctttataaacataaccttaaggcttgtttcatgttaagcttgtttttaaaagcagaaataaaatgtcagcataaaccagctattaatcctgtgtaagatttggaaaatgagtatcaaaccagttttggacctaccaaagccttagctttacttaacagtgttcatgaaaagtattttattggcaaaagaaaactttaaattcaatcatacatttcaaaaatggggtcatattcttacctggaaatttgatgtccagcatagaggagcagagcagtcaaaaaatatagataaagctgaaccagatgctgcctgggcaatgttagcagcaccacacttaagatataacctgtaccagaaagataaataaaatacaattttaatttagtttcccaattaattacaataaaagaaagagcttgagacaaataattttccaaataggtttcagtactttctgaggttttttattatacttaccaaagtaagtttagcatagtgacacccctatggattttttgttgttgaaaatgtattgtgtttttcacttcttttgtagatttctctacctaataatcaaatatatcacacaaatgtgtaacacaactcctttcttcatctacctttccttgatatcaacttacttgttttatgccaattctctctttctttctagtcccagaggaaaaactgggtgtcttaatgtctctttccaaggctgccccttccatgtgatttaagaccttatttctccaacccctgaagactctctatctcctatactttcagtcgttccccctgacatcactccttacctttgtttcaaagaatgtgcagggcttttacccatcttgagaaaaaaaaaataaacttcttttcactgcgatttttttcctattatttttctcattccactgtcaaatgtttgaaaagatctatacccaatgcctctattttctaagcatctattcttctctttaccatctacaatccctttacaaacccccctaacttgtttgctctaaagaaagttggaagtcaacgactgcctacttatcacatctaagacatcctgcttatttttgatccccaatatccaggcaacgaccatcaaaacgttgttactctttggctctgttcatatggatttcctcttaccctctaacttctctaatttcttttcacgctttccaataaacactggaaatttggttcctaaacaactgtttttctctatatataaagtacctagtgcaaacaacatattttgtaacttcaagtatcagcatctcttctataaatgttatcaacaaagttactgataacttattatacaggcaaaaacatatcctcatttcttaatctaagtagacatcccatctcatgacacctgagatatattccacttaaatgttctcatattcaacaagtacaaactgtgctccccacctcctccctcaacaaagtaactcagtgactcaaaacctgtcatcttttctctcttatcgtcaagtcctgctgagccttccatgataaattcctctcatgtgttacccttccattccaacctctatgtcccatatcctaatctgctctgcaatgcacagtatactaccatccttctttcagtctctatttttgtataccctatacttcaagcttgtccaacccacggcccatgggctacatgtggcccaggatggctttgaatacagcccaacacaaattcataaactttcttaaaatattatgagtttttttttttttttttgcaattttaagctcatcagctatcactagtgttagcatattttatgtgtggcccaagacaattattttcctaatgtggtccagggaagccaaaagattggacaccctgatatacttaattaccagggtaatattcctaacaccatcacttttacttgacaattctcctgctctaaaagttatgaacctgacattcttggtcttacacaatctggacccagtctactcttctataaccatcttccacttaatttacaaatctttattaaggcacaggtactcctacttatcccctattgcctctctcatgctgaatcaatcatgccaaaagctaagaaaacatgagcatgcttgggactaaagaaacagaactgaggatttcctacacatcctaactgcaaggacagtccatcaaaagccagagataagtatttttatttgctctttatttcttaaaataatttccccaattttgttaacccctacctcaaatgactttagaggtattttaaaggatatgtaatatagttactaagcatttccactgattgtagctgaaggattttctaatgtctattacatgaaacttctccttaaactctcttttaacgaaactgtcattttcctttccagaacggtcttgtcttttctttctcctatatatcgcatataaaatcagcggccaaatcttctagatcaaacatattcatttcatccattccttcaattatccagtcattcaatcaacattattatgtgtaaagtatgacccacttgcattcctagacatggaagatccaaaattaatgtgaataataatctagtgaaaagataagcatggacaaaagtaattattagacaaaattgatgctataataaatgaacattggaagggctatggttaagtgattaagcttgacttggatctctaaaggtgaatggttctttaccaggctaagaagaaaaggaaacattctaggaaaagagaacagcaagcatgaaaaccataaaagtgtaattttcaggggacagtaaattctgtacgttagactagactttgatgttaacagaaagattgggagatgatgctgaaagaactagcagctaaagcctcaatataaagcctaaatacaataatcaagaatttagacttagctaatggttctcaaattcttcaatatctatttaggtgaggtaagagaacagaaaccaaaacaacaaaagcaccattgctcatctataccccatttttatattccagtggaaaagtaactctgtgataacaaaatatttgtgtaagaaaactttgagagacaatgaatactaactatgagagcagtatgaatgaaccatctgaactacgatgtatatataatctaacaatttaaaaaatgcaagccaaaaatactattgacacaaacatgcatcacaactcactctacagcattaaccaaacaatccataacaaactaagttgacaatggcaaagctgttagtttttaaattatacacagtaatttgtaattaaaaagcaagaccagtggcatttaaaaatgatgacctaggccaggtgtagtagtgcacacctataatcccagctactcgggaggctggggtgggaggatcccttgagcccaagaattcaaggttacagtgaggttatgattgccagtctgggtgacagagcatgaccctgtctctataaaaaataagggttggatgtgttggctcacatctgtaatcccagcactttgggaggccaaagcagaagatcacttgagcttaggagttcgagaccagcctgggtaacacggcaaattcctgtctctacaaaaaaatacaaaaaattagccaggtgtggtggcacacaactgtggtcccacctactgaggaggctgaggtgggaggatcacacgagcccagaaggttgatgctgcagtgagctaagattgtaccactgcactccaatctgggcgacagtgagactctatctctaaataaataaataaataaataaataaataaataaataaaagaaataatgacctacgggaacagactctgagaacagaaaaaataaaaaataaatcaaaatgatgacctgcttaaaacaacactgatgaatctaataatttctgctatttaaacattatggtagttgtagggtaaacagcaggaccagaggtaagatgagagcctggattgtaacagtagctttgggtatggagctgccagtcagccatgagatacatatttaaataggtcttagtggttatctgtgggtgactagttgagaacaaggaagtgaagatctgatgtttctagcttgggtaatcaagaagacagctttgctattaagacaggaaacacagcaggagaaagacttctgaggtgagaaaaaggtgatgagttcagtgattgacaacaaattgaaatgtccataggctatttaggtggaaatgtctaagaagtaattcaaaatgcattcattcagggctgggcacagtggctaatatctgtaatcctagcactcttggaggctgaggcaggaggatcactttaggccaggagtttgagaccagtctgggtaacaaaacaagaccttggtatatgcctgtagtaccagctactccagcagctaagggttacttgagcccaggagtctgagactgcagtgagccatgatcacaccactgcactccaacctgcgcaagagtgagaccctgtcacgtacatacatacatatatataaaattcattcattattgggcaccagctaggtgctgggaatactgagataataaacaacccccttcttaccttaaaggagctcacaatctattaacagttgggaaaatagataagcatatggacccttagaatgcaacataataattgctatggtagagatgtgaactggttccatggaatcacagaggaagaacatcaactccagactacagtggtcaaaaagcaatgtaaagtggagacagagatctgcagcccaaactacgttcggtcacccaaacaacaaaagattaaaattaaacacaaattgtgggcaatatcaacacttgagaagtctaaagaaaacaaatcaaaagaatcagaagcaatggtcagggagttaggagaaaaatcaggaaaaaaaaaaaaaacactttcaagaaagaggaagtggtaaacagctccataaacatagaaaagtctgtagaattaggacataaatgagggttgaattttacattttaagtcactaatgattttagtgatggtagtttcaaaaggattttcgcatccatttcttcctttctaatttctaccttgccagttctggctctcattacctcttgcctaaaatcctaactggtcttcttacctccagtttctcccctccccaatccatcatcctataaaacgctgcctaatcaatcttaaaatgcagctcacctgctctaaaatccccactgacccaccacgacctatagaattaagcaccatatctactgtatgtattcaggattcttcacaaaagccctattctaccttaccaatattacttctactcctcctttcatatcctacactccaaaaaacagtgggcagtcacttctctttcagcagaacccaccctggaaagcttctaagtttgaagacacaattacattccattaaatacaaactttattgctccctcccttaatttttaagctccttaattacaattagaagacataaagggggaaaaactcccacttacgatagcaataaaaaagataaaatacctagaaacaataaatgtcaggaggctgcggcaggaggatcacttgagcccaggagttccaggccagcctgggcaacacagcaagaacccatcctccccacctgcccccaaaattagtaataatgcaatctaaattttaaaaaaaatcaaatgggttgctttgtttttggaatgagacctagacaattttgagacaattcttaaattcacatagaaaactaaccataaaaaaaaagctcagaggaggaaataaagaaaactgaagggactaaccctgttagacagtaaaatataatctaaaccctcaacaaataagacagcgtgttaatagttcacaaacaggcagacagactaaaggaagagaagttcaaaaatgaaacaaaatatatgtgagaattcagtatataatgagaaaaaaatggactaaataggtgaggatgactgtgtggttatctagaaaaaataaaattatacctataacacactattcatacagataaatgaagcaaagatttaaatgtaaaaataaacccacaaaaatagtaagataaaatacaacagaattctttataaactcaagaataaagaaggcttttctaattgactcaaaatactaaagcttaaaaaccttctaaatgtcaaaaaatcataagcaaaatcactgagttgaaactggaaaaactattttcaacttatcacaaaggattaatttccctaatgtataccaaattcccacaaattggtaaaaaaagaatctcacagaaaagtgggcagggtatataaactgacaactctcagaagagaaaatacaggtttttcttaagtatgtgtatgttcaattcattcataatagaaatgcaaactaaaactacattgagttaaaaaaatcaatttttccacctattggagtagccaaaatatttgtggtaacaggctgttttgataatataggattgtaggaactctcaaccacggtttttggaggtacaaaatagtaaaaccctatggaaagtactatctgtcaacactacaaatatatataagttaacccttgaacaacataggatggaactgtgagggtccacttacatgtagattttttacaaccaaactcttatggaatacagtatttgcaacatgcaaaacccacgtatacagagggccaaccttctgcatacatagttccacagggtcacttgagggacctgagtatgcgcagattttggtatacgtgggcatcctggaaccaacttccagcatacaccgacggaccactgtactctttaacccagcaacttcgcttctagtaacttagccccaggttatatttgtacttgttgaaattatagctatacaaagttatttagcacaacgctgtacaaaatagcagaaggtaggctatctaaaatgtccaccaatggagtaattagttcaataaattatggtatatccatacgaagatactatgccaacgtaaaatgcaatcgggaagaggagaaatgaggcctcgatatctactcaagagagtctttaagatccggcagactgtcatcataagaaaaagagcacaaaactctatttcataaatatctaaaagcagtagttatggctccacatacatcacaaacaaaaaccatgattcaaaaccatgtataccatgctaacatctgtataaaaaggggggaaatatacattttttatatttacttatatatacataaaaatatctctagaattatacagaaagaaataaaagctacatggtgttcagagtgagaactcagcgaatgagtaacagagatgggagggagatacttttcattaaatactttttatgcttttttatttctgaatgtagatacattattttattaaggtgaaatttgatttgtatttgagggtgaaattctgtaaacaggagcattacataaacactatgtaatattttgacaaaggtaactccaaccaaaacattgttcaagctgaaaatatctgttcatgcaaccactgagcttactctactttggcatggagtaagcatatttaagatggctcaactaactttataaaattataaaccagattatgaacttcaattgtactcgaaaacattcaatttctaaaattaatattcctggttatcaggcagctgtttttataataaatatttcaacctattcagaaacaatatataagcacatttttaaaaccacagtatgtatgactttgctgattaatctaaaaatctaagccaagtacccagttgttctacaactgacgggaattactttccataaattggctaacatacaaagcctttcataaaaggctgagaattacagtgttttgcaacataaaggaactttcccatttcagagacattcccaaggtagtgctatccacaaaagatgagtttactgaaccgaaacgttttgtttctagtgcaccatctcttctactacatcatacttctttccacaacagcttacctcttagggatgtaaggggaacgttctcagggctaagttttagaacccagaaagtgataaaaataaatctcagagagacaggacaactcttcatgactttataaaagatatattttgtgacaggcaactctaataataaaatattagcaaaaccactatagtaccattcaaaccatgtctggaactctgcaatcacaacattaataaaatatattgctatatacattacaaataaaccaaaacctaaaaagtaaggatcatgatttttattctaggtaaattttatctgtttcatgcttgtatttcttgactttaatttcttcaatctcttatcattatttttaccactaaccccatagcatatcaatgatagttccatttttcttgaaaggggattcaagcaaaaaaaaaaaaaattatagttccaggaggattttttttatggaacaaagtattatagtatcatttcccaaatttcatttaactgaacactttatcttcagctgatgttaatgttttcgtttatctcagggaacaataaagaatgttgcattttaaaaagcttactttctgaattactaccaaaccccaaaacaaggacaaattagaaggggccaaatgtctctaaaagtatttctcattgtttatatttcatcatattaaaatctagaatgttttcttctgccttccagttttatccagtaaaataaatccaatactgcttactttcttgtagccttaataattcatgtgcaatgataagacaaaactatcaagattcataaacactcatcaataactatatcactatcatcttaatgaaaatgaacttcattttacccaaattcaaaaagatactaagacataaatcagaatgctcactagaagattagaaaatgtgatgtagacactcacctacataatgcatattaagagccaaatacttatactggaaaagagggttattactaaggctacttctttggatctgctggaaaaaggagctgacatcccatctgtacaggacatccaacagcatgatgcttggcaccctcagggccacatttaacactgcctccagtttctcctttgcagccatgttgtttttttttttctttttttttttcttggagaagacctaaaattcagaagacacaatatataaaaataaaaagtcaacacaaatcgcttttagataccctttcacgaatctaataggttgtcacacactgtacaaaactatgtgagaacgtatactacttctcagccacaactactatttttagatattcataaaataacctctgtattgtgttttcacattgacccattcagttctgtccaatcttataattctgattaaatgttctggcctcaaaactaattttttaaaaggccactaactccaaatctaggaacaaaacactctgtaagactactgtaacttgtataaaattaacttgaaaaattcactcactccaataaaactatgatttatgtagctcataagagggtgaattttgaatatttactctatgaaaaagcctaagcaattcaataaaaacttgataactgcacgtttagtttgcagcatcttgtactctatgcttttccttattcacttacaatcaaaattgaagtgctaaatttacaatccagagaactcatgatgtagatacaggtagagggaacattatttacaatatcatttccttgaatctttaaagttaaatatggtctaaaattcccataatctgccttcaagtgttcatcaaattcttcccttgatacacagataagcaggcacatggaagacgccaggcattgagtctgcagcccctgtctctgcacagaccatgataagtagtgggggggggcagggggaggaggaaatgaaaggcagttatcaggacaatttactatttaaagggacaattcaatgccatactgctttatatggtagaacttcaaattaatccaaaaaaatataaaatagggcaaacaaggccgggcgcagtggcacacgcctgtaatcccagcactttgggaagccgaagcaggcagatcatgaggtcacgagttcgagaccagcctagccaatatggtgaaactccgtctgtactaaaaatacaaaaattagccgggcatggtggtgcacacctgtagtcccagctactcaggaggctagggcagaagaattgcttgaacctgggatgcagaggttgcagtgagcagagatcacaatactgcactccagcctaggcaactgagctagactccgtctcaaaaaaaaaaaaaaaaaaaaaaaagcaaacaaaagtgggtaaagaacaatttaaagagtaaagataattctggattgttggctctgacaatatccttttaagaattttgctgagaaagctaaacacatttccagctttagcagtaatttcagacattacaggacaaacgaaaacatttatttctgcagaaaattatagtgacagattgctatgctatggttaaatatttgtcagtatttccatcttaccctccaattttcatagcttcctagttcagatagtcaaaaagctaaaggcaacccaacttggcacactatcaataaaagcttttcaataatcatatatcaaccattcccataacccaaatgttttatatatatagcctgccaataatatagatttaacatttttatagataagtactgcaattctgattatttcacatgaacaagatcattttcataattttcctacataagaaaaaatattattgtgaaaatcagaactaaatatcatgtcctaagaaggaaaaatgcactgaaaaataaaatctctaacctttaatatttattgcaaaccaaccactgaggaatctaaatttctcaaagcccatgatattattattttttctaatcccaggaaaaaatacaccaaaacattcacagaaattgttggtaaagagtttaatgcattttaatgtgtataagccatctagataacttcaggaattacagtggaaagacttactttggtgagcaaactgataacccaataccctcttgggaatttatttcaaagtaatattgaatagatcttctcacaaaccaccagccaccatatttgaaaatcaccacgtactgagatgacagtattactgacagtctttatactgccatcgaaaagtaactatttttctatattctggaatccaatataaatcattactctgtttttataagtaacaagagagggaggagctattactgatttaacacttgtagcccatatttatttcatttgatttggaacctttctcttttttcaatgctttgctattttaaaatgtgcccattttcaccatttactgtggctcctaaacgggtaaagaagaaaatttaaactaaacaaataactaatcctgctttagaaatcaagatctgctagggaagaaaaactccctaatccgtacagaggatcatctctattacaaaagtccattagcagaatggtacatgttccctctttatttccacccaccactcctgcctaacaaatataataagaaacagaaaacaggacacatttctatttctataaagagaaaataccgggtcccgaaagctgtcaataaaaaacaatatccaagatccccctctactacatagtcaactcgagactgaaatgtttttaacaaggactttggatagaattaaatacgcccaaataaacgaaactaaatgttgcatttatttctatacgtgaatgttattttagcaagtcagtggcaagctggtcatgtataaaggcactgacgaaacaaatttaatacatggaaaatcaaagagaaaaaaatttcaaaaccttatcactttgaacccttctaaagtaaaagagcacatgatagttatcaatacaaataggtactttacactacactttagcaccacacactaaaccaacatcaaaacaaaactttaaaatattcatcttctttgcaagtacttgcaattactcacacctgccaaatcactatatcatacaaacacgaagtaaaatggagccttctctcctgatctagagaatacctttataatgttgcctaatttatcctgttccagatttattgtcaaacagggctaatcagcatatcctaaagtacaggggagctcaatattctcttgaaaacaaaataataccaaataatcctagaaaataagcaggagagctgaaagcagaaaaaaccgaaaggtttaacacacccaaagccaaatacataaacttcctatactgttttatcttccatgcaagattttaaaatgtcctccttgaactttgaaaagaactgggaaagtaatatccaacatgatgtgtctgcaggtaacataaactaaatgtgactcaaagatgttttacacagtaaaacagctaaaaacaaaccaaaaaaaaaaaaggcatttctttccaaaaaccacaagaggtgcaacaaatgctaaccaaaaaggagacctcaatgagttcattaaatgaccttctcaggcttagaagcagcaatccgtaattatgaaaacagtaatgtcttgtagaagtataatgctgtacagtttaccattcaaatttgtgggttagaaaacacagggggcttcattctacactttcctgaaaatacgggattttagttttgaatatgaagaaaccaaacaaatcgtcctgaataagaaaaatgtaggtttttacagtcacagctaatctctgaagaactatgtcaaataagagaaatgaaaaatgtgattttttatttctcttatttgagttcttcaaaaatacacctcctaaacttttttttaaaaagacaaagaaaaaacaagaatgacacgtgacccaacttaaaactattcagtacaatacttctacaccttccccctaaaaaagaaaaacaaaaatcatcattcaccattatctcctttctttctcccaaccagttaaaaaaaaaaattctaccatcaactaaaactgatcttaagaaaagtaaattttcgggctgtccatcggttaggatggtaggcctcactgaaaatgttaagagcacaaagctagagcctaaaattctaagtaaaagcccagaactgagataccaggaaagagaacgcatttcttacataagcaatggcacatgttttaaatatagctggtcctccccactcccactccttgctagctaactttgtatgtacctgatctccacataaactactagcaattctgtggtttctcatcatctcccaaaccgcaaagacagggagtctactctgaatacaaaggccatctttcaacttaaggaacagagagaggaaataaaactgctacctctgccatcggccgctcagcctgggtcacgactgcagcaccgacagctcattcttttgggcatgattcaagattcagtaaaactgcacactccgtattttaaaaaataaaaagacacacagtcctctccttccctttcagactagtttcctctttactgcagactgcgacgcaaggccatccactaatctttgatgcctgctcactgcacaggccccttcctctctccccgcacctcctcccacaacgcctgcagatctcagatgcgtttgaactacagtaaccccaacccagctcgcggcaagcaggcagcgcagcagcagtagcagcagcaaccgggccgccgccgccgcggggctaagagattacgttcagcaaaaactcttccaggaaagaggctcgagagctcccctcctatctcgccaagggtgctgactctgtcgcgccacgccacgtaccaaaaggctcgcgaagaaaaacgcgggcgaagttcagcatccccgaacagaaagggaactcattccagaaagggggttcacgggtctgagggtccttgggtggggaaagcagtattggagggagaagacagaagggatggcaagacagaggaaaccacggggacaaaaaggaagggatgaggagccctcttactataaaagggactgacggacgggatgcagagcaatgggcccccctcgaaaaatggactggcaggcccttccgcacccccaaacaacctcgcaccacctgaaagcggggagcttgagtttggggctgcgtagatcaaagcagggtaagacgaagggaaagagggaggggagcttggaagcaaagtgaacaaagaggcaaaagaggcaaagttggaaatggaaacgagaaagggagctggaaaggggccgctctggaagggtcttgaaaaaggcctagaaatgggatgctggggaggcaaagggggacagccccgaggaagggcatctcaggaatgtaagggagcgctccaggccctgggaagaggaagggatgggagggcggggaggcagccgaggcccgggagctggaacagagggggctttgcgcggggcccaggaggggagagcagggtcggagggaggcgaccaccgcgggaagagctagaggatgggagggaggggtgctgcggctgaagaggggatgtggactcctccaatgctagggagaagagggaggtgaagcgagataaaaggaaaggggcgaacagggagaagaggaaggagcctgcgacgcgatgggggaggggagggaggccgtgggaagcggccggggggcgcggggatgggaaggggccgggcgggcggcgtggtcacctcaggctgcggactccctccctggggagcggcgctgccggcgggcgggctccgcaactccccggctctctcgcccgccctcccgttctcctcgggcggcggcgggggccggtacggcacggctcacagcggcggctcttctgcgccgagcctcggatgttgcttctggggaggcggaggcagcggcagcggcagcggcccggcccgtacggtcaccatcgtccgcggcagcaggcgctcgcgggccgagccccttagcagccggcgccggcgtcggcggccatggcctcctgcgtttgctcctcccgcccccggcgctctgcggcggccgcggcccgacttccgcactctgcgcctgcgcgcggcccagccagcgcggcgcgcccctcccgcgcgcgcccgcgctcactcacaatcgcgcccgcggagtgctttccgcaccgcctccggtgcgtgggcgggagacataagcctagccaagcccatacagcccggctcgggtggctatggagaggcgtactgcagagacacctggacgcgcactgtgacaggcgccattctgacacacgtgctctctcactcccaaacaccacgggccgcaagcgctcacacccacactcacctgcagggaccacgtgggagaatttgaagggctgatcctgtcccggtgcattcgcagtagcaatgatgcgagaattcgttttaacctcgtcactgactggactagactgtaaactccttggcgtctgggatggctcagccgtgcccagcaccaagtgcaggcactcaaacccctgtggagtaagtgactggatgaatgaatgcattggaactgttcactgagtatctgtaacaattttgatcccatggtttggtacaaagaattttattgcagtatgaaattaaatggtgtttgtgtgtttgtcttgtcttggtctaaggttcaaaacaggctaatgtatgttttcccctccccaacgtagaggagttccactttgtctctgtgccagtctctatcacagaatgcgcaatcctaccctaatttaaatgtccacaccttttagggcaggaactgttgcccagaatacatagcctgaagcatattgtgtgtttacacaacgatagtcttctgggcttggcaagacttctcattccccatttgtctgccactctgcctcaccacgaccttctgcaacccccacttctatctcccctgccttccaccatcaccaaaacccctccactgtttcttgctttctctttcgttagttcctggggagccagttgctatgagcacctagcctggccttagatgttgaaagggccagtgtacacagaagatacacacccagtgatgggtaagatgttgcaactatactgggtcatgctgaaattgtgaagcctcaacttcttcatgtgcaagagaaattaatgtactgtaatctcgatgtctgtgttgaggaccctccttgtaaattcaagtctctggcctctgccctttgaatggtaaacccccaattctgaacactcttgtatcctgctgaaattgtgaaagcaagctctgtatttagaaaatgcaatccctggaggtatcagtcaaccaaactctgagtaacttgccttccattagtttgatagctctgtaggaatcaagtgtttaaaatgtgtgggaattgtgtacataactcactataaccacctttcatccaggtgcctcagactacttcaccatagtcataaatcctgtcacatcccagtgatgcagttcatgagtctcttaatctagcctggtaagtaaaaaaattacagaggtcacatgaataatgactggaataggaaatggaccaagatagcaaggccttatcttgatcccctccctgttttaacaactttacatctgactgagtcaagaaaacctaaggccagaaacagattacaaagaagtcaaaatgaacgtaacactaaattctaactttatttatttattattcttggataaatggcagaatcctgaaaatgtgattctaaaaggaagtatggttgctggatttgcgtggtttttgtttgtttgtttgtttgttttttgagacggagtccactcttgttgcccaggctggagtgcagtggcgtgatcttggctcatcgcaacctccgcctcctgggttcgagcaattctcctgcctcagcctcccaagtagctgggattacaggcatgcaccaccacacctggctaattttgtatttttagtagagatggggtttcttcatgttggtcaggctggtctctaactggatttgtgttttaaatggaggagaggcctacttcagctcttacctttcctttttttaaagtggagaaaatggcttcaaagccctgtaaccctcactggaagtattctggacttgtaaaagcaggaaaaagtcacatgtctttttaccttttaacttaatagcagctgcctgtaaatgctgaagttcaaaacaagtaaagaaaattactctggtaatgaaagggttactgctattatagtgctgctaatccagttatgggaaagctccacattgccagaagcaggtaattaaacagaactaaaaagcaacgcaaaagaaaaaagaagtgggggtggggcgggtgaatcgagagcagctcaaataaaagagctcaatcaagtgtagaggaagtactttctagaggcacccaaacccacccaaatcaggaaaagccaggagctaaatttgtccttaagtacctggaagaaacataaggaaatgtctaaatgccacagcttggtcataaaaggaacttacccagggtgctagaaggaaagaagtggtatgtttatgactgcccaatggcagaccattcaggattcgaaaggttatcttccttcctgtctaaatgcatccaacattgaggaggaagtcagcacaaagtttgaaagagtgcatatatgttccagttctagccattccaaaagactcgttcctgaattcctgatagagccaactattgctaatagtcacatagaaatagtcttgtgttgcaaatccgcaggaactgatggccactttattatgcactgccttctaaatctagagaaaatgatataacggatttcacatgttggggccaaaatccaaagaaccttggatagccagcattgggaatatgagggagaattttcatgtcttcatttcttcacacactttcttgttcctaatgttttctgggcactttgaggttttctttatccaattcaaacaaccagatattcaaagatatccaattcaataatcaactccctaattagaagagtctagataatatatagaatccattcaacctggctaccctcatggtttgattttgagagccaactctataaggaaaactatagttttgttaggcaacattattcggtaaagggcggttcactctttttttcatatatatatatatatatatatatatatatatacagcttaattgacatataatccacctgttttaaagtgtacaactcagtggtttttagtatatcctcagagttgtgtaaccatcaccacaatcaatttcagaacatttcatcataacctcccgccggggaaaaaaaaacccatatccattagcagttgcttaccttctcgtcccagccctcagcaatcattaattgttctgcagtcactaatctttctgtcagatttgcatgttctggacttgtcatataaagagaatcatacaatatgtagcattttgtgtctggcttactttacttaacatttttgaggtccatgcatgtgtagcatgtattggtacttaattttcttttcttgccagataaaattccattgtgtagatagatataccgtgttttgcttattcattcatcagttgatggacacttgagttatttccactttttggcatttatgaatagtgctgttatgaacattcatgtacaagttgttgtgtggacacattttcatttgtcttggtagaattactgggtcatatagtaactctatggtttcactttttgaggaactgccagatagtcttccaaagtggctgcatcattttacattcccaccagcagtatatgagagatttactcttctattcagatgcttcctatctgctagctatgggaccctgtgccaagtgtacgtaacttaagaacacctccatttattgtctgtaaaatagggatagtgataatatctactttgcggggttgttgtgaaaaataaatgaagtgatgtgtgctaatattcttggtacaaagtcctcaatagttccccctccttctttttttttttttttcctcgagacagggtcaagcagtcctcccacctcagcctcctgagcagctaggactacaggcatacgccaccacaccagctaatttttgtgttgagacaagatattgccatgttgcccaggctggtctgggctcaagtgatccacatgcctcggcctcccaaagtgctgggattacaggcatgagccacagcacctggcctagttcccttccttctgtctgtagtatttgattgtcaacttttattctctaatagggagataaagatgaaattgtaactttatattaacactaagtgattcatacgcatagctggtgctgaataaacacttttcgtggataactgaaaacagcaatagaacttatattgttttaacaccaaaataaatgtatttctttctccctggtatggaactaatacctgagactataagaagagaaagcatagaaataagtcagcttttttgtttgtctggaattttcagatttttctgaaaacattttttatttccccacattttaagagtttcaaacatatagaattaaaagaatattctagtgatcacccatatgcataccatctagattcaacaattggtaatttttgcatgtttgctttatctatgtgtgtgtgtcttttgctaagctattttagagagctacagacatcaacacacttcactcctgaatactccaagctgctgcttctaaaaattttaccaattaccgttaccgcacctaagaaaatggagtatagttctctacatcctctactgcccagtcaatactcagatttttctcagttcacctcaaaatatctctaaagaagatccaatctgacaagccagctttgcttttcatcaatctgagcacctgtgactgtttagaatcactaacatcagcagaaacaaattatatttttgctgttgttttcagattttagctcaactggcacctctgttctatccagctactttctttgccttggttctgattaagcctgaggtagggagtagtgcaaaactgtgtgttgttgtttatgtgtgatgatattcaactaaataaaatggacattgattgtcatagacatttgttagctacctcctcgctattcttctcctcttcttctttctaataccaacttgaaccttgaataaacaggtggtctgttggccattgaccaggaatgggctccaccagtttatcctttctcccttagtgcttagtccagggaaggacccgtgagccacattgggccaatcagaggtaggactaaacatcagaggttttgactgagctatgggaagagcaaagtttctcttttctgctagacctaaaaaaggaaacctgtaatcccaggaatttactggcagctatctgggatacaaaaggaaagaaccaactgaagatttagccaacagaagaaagagaacctgagacaaaaaagaaaccaggacctggtcacagtgtaagagctctaagccttatctgaagccagcatgctgacctcctcactctttaatttatattacccaatagattaccttttttggcttaagccagtttgggttgtgtttttgattatttacagttaagagtcccaaggcattcaatccttataatttgcttgtcacccatccctgagtataatatgctgctatgaacataaggaggtaactaataataataatgttaagtacataaaaacacaattgtacagctccacatactattatgaaatacaaccatttaaccactatccagaaatataagcttgtccacatcccagaagaccctcacatgccctttcattcacagctgtctcactagccccaaaggtaatcattttcctgactttaatgtagtcactttcttttctttctttgaccacctaactatgaattcctgaaaactgtagtctagttctgcctgttcttgaatgctatataaattgcataaaataatcaagtattagatttttttttccttttttttttcttttttgagatagagcctctctctgtcacccaggcttgagtgcagtggcacaatctcggctcactgcaacctctgcctactgggttcacacgattcttctgcctcagcttcctgagtagctgggattacaggcatgcaccaccatgcccagctagtttttgtatttttagtagagacagggtttcaccattttggtggccttggacccctggcctcaaatgacccatccacctcagcctcccaaagtgctgggattacaggcatgagccaccatgcccagcctagatattcttttgtgactagctttttctccttaacattgtgagattcaattacgttctcgtgaggctacagttatttcattttcattgcagtatagaattgtcctatgaatagaatatgatttaatcatcctagtacttatgaacattgaatttatgaacattaaagtttcattttggagccataggtatggtgaatcatgctgctgtcaacatttttgcacttgccttcctggtcaccacctgtacatatttcccttgaattgctgggccacagggctacgtatcttcaactttcttaggtaactccaaactgtttttcaaggtgattgcagcaccttacttgcctaatagcaatctgggtcctgttgccctgtctcccagcctatgattggtattgtcagacttttaattttaaccattctagtggggtttttaacttgcatttccctaattgccaataaggttgagtactttttcgtattttgggggcctttttagatttcctttttgatgaattgctcaagtcttttccccagttttcccttacgttgtcctttgcttattgttttcttttgtaattctttgcatattatgaatgcaagtcctttgtcaattatgtgtcaagcaaaatgttctgttatgtagcttccctttttagtctcaaaatgatgtcttttgaggaaggtaaatttttagtttaaatttaatattttttatttgtaatgcttgttttaaacctgttttttctgtgctccacagcaccatctctgtcataaattgagtgtgcatatctgaatagatctgtttctgaactttctattctatcccactggtttctttgtttatccttgtgctgacaccagactgctccagtgactctaagaagctgatatgtggtaaagcacatcttcccacttggttttctttgttttgttttgttttcgggaggatcttggttctttgcatttccttatcaattttggaatcagcttgttgagtttcccaagatcgtgctgaggtttttagtttccacgtagatattttacatatctcttgttacattaattcctccatgcctggtatttttttatgcgattgctaatggtaatttacttttttttttttttttttttgaagaggagtctccctctttcatccaggctggagctcagtggcacagtcttggctcaccataacctctgcctcccaggttcaagcgattctcctgcctcagcctcccaagtagctgggattatagttgcccactgccatgtccagctaatttttgtatttttagtagagatggggtttcaccatgttatccaggctggtctcaaactcctgacctcaagtaatccccccatctcagcctcccaaagtgctgggattacaggtgtgagccaccccacaggccggaaatttgcattttattgtatgttaggctttgaggatgtaacagtaaatctcaagagtctctgaccccaagaccttccaatgtcttagagtgggggcagacacataaatgatgtgggttggttatcacagatatacaaagtggtgtgggttagttgtgatagaggtgagaaaatgttaccatgaaaatgcaaatagtgtgaagtgggtgggattagcccatttgtgggttcttgaggggatggggagagatattctgagtgttgaaaaatgcataggagtcagctgaacgggtgctgactcacacctataatcccagcactttgggaggccaaggtgggtggatcacctgaggtcaggagttcaagaccagcctgaccaccatggtgaaaccctgtgtctactgaaaatacaaaaattagctgggcgtggccgggcatggtggctcacgcctgtaatcccagtactttgggaggccaaggtgggtggatcacctgaggtcaggagtttgagaccagcctgaccaacatggcgaaaacccatctctactaaaaaaaaataaaaatattagccagacat

SEQ ID NO: 16 - DNA, 88409 bp, Homo sapiens
aaaattctaagtaaaagcccagaactgagataccaggaaagagaacgcatttcttacataagcaatggcacatgttttaaatatagctggtcctccccactcccactccttgctagctaactttgtatgtacctgatctccacataaactactagcaattctgtggtttctcatcatctcccaaaccgcaaagacagggagtctactctgaatacaaaggccatctttcaacttaaggaacagagagaggaaataaaactgctacctctgccatcggccgctcagcctgggtcacgactgcagcaccgacagctcattcttttgggcatgattcaagattcagtaaaactgcacactccgtattttaaaaaataaaaagacacacagtcctctccttccctttcagactagtttcctctttactgcagactgcgacgcaaggccatccactaatctttgatgcctgctcactgcacaggccccttcctctctccccgcacctcctcccacaacgcctgcagatctcagatgcgtttgaactacagtaaccccaacccagctcgcggcaagcaggcagcgcagcagcagtagcagcagcaaccgggccgccgccgccgcggggctaagagattacgttcagcaaaaactcttccaggaaagaggctcgagagctcccctcctatctcgccaagggtgctgactctgtcgcgccacgccacgtaccaaaaggctcgcgaagaaaaacgcgggcgaagttcagcatccccgaacagaaagggaactcattccagaaagggggttcacgggtctgagggtccttgggtggggaaagcagtattggagggagaagacagaagggatggcaagacagaggaaaccacggggacaaaaaggaagggatgaggagccctcttactataaaagggactgacggacgggatgcagagcaatgggcccccctcgaaaaatggactggcaggcccttccgcacccccaaacaacctcgcaccacctgaaagcggggagcttgagtttggggctgcgtagatcaaagcagggtaagacgaagggaaagagggaggggagcttggaagcaaagtgaacaaagaggcaaaagaggcaaagttggaaatggaaacgagaaagggagctggaaaggggccgctctggaagggtcttgaaaaaggcctagaaatgggatgctggggaggcaaagggggacagccccgaggaagggcatctcaggaatgtaagggagcgctccaggccctgggaagaggaagggatgggagggcggggaggcagccgaggcccgggagctggaacagagggggctttgcgcggggcccaggaggggagagcagggtcggagggaggcgaccaccgcgggaagagctagaggatgggagggaggggtgctgcggctgaagaggggatgtggactcctccaatgctagggagaagagggaggtgaagcgagataaaaggaaaggggcgaacagggagaagaggaaggagcctgcgacgcgatgggggaggggagggaggccgtgggaagcggccggggggcgcggggatgggaaggggccgggcgggcggcgtggtcacctcaggctgcggactccctccctggggagcggcgctgccggcgggcgggctccgcaactccccggctctctcgcccgccctcccgttctcctcgggcggcggcgggggccggtacggcacggctcacagcggcggctcttctgcgccgagcctcggatgttgcttctggggaggcggaggcagcggcagcggcagcggcccggcccgtacggtcaccatcgtccgcggcagcaggcgctcgcgggccgagccccttagcagccggcgccggcgtcggcggccatggcctcctgcgtttgctcctcccgcccccggcgctctgcggcggccgcggcccgacttccgcactctgcgcctgcgcgcggcccagccagcgcggcgcgcccctcccgcgcgcgcccgcgctcactcacaatcgcgcccgcggagtgctttccgcaccgcctccggtgcgtgggcgggagacataagcctagccaagcccatacagcccggctcgggtggctatggagaggcgtactgcagagacacctggacgcgcactgtgacaggcgccattctgacacacgtgctctctcactcccaaacaccacgggccgcaagcgctcacacccacactcacctgcagggaccacgtgggagaatttgaagggctgatcctgtcccggtgcattcgcagtagcaatgatgcgagaattcgttttaacctcgtcactgactggactagactgtaaactccttggcgtctgggatggctcagccgtgcccagcaccaagtgcaggcactcaaacccctgtggagtaagtgactggatgaatgaatgcattggaactgttcactgagtatctgtaacaattttgatcccatggtttggtacaaagaattttattgcagtatgaaattaaatggtgtttgtgtgtttgtcttgtcttggtctaaggttcaaaacaggctaatgtatgttttcccctccccaacgtagaggagttccactttgtctctgtgccagtctctatcacagaatgcgcaatcctaccctaatttaaatgtccacaccttttagggcaggaactgttgcccagaatacatagcctgaagcatattgtgtgtttacacaacgatagtcttctgggcttggcaagacttctcattccccatttgtctgccactctgcctcaccacgaccttctgcaacccccacttctatctcccctgccttccaccatcaccaaaacccctccactgtttcttgctttctctttcgttagttcctggggagccagttgctatgagcacctagcctggccttagatgttgaaagggccagtgtacacagaagatacacacccagtgatgggtaagatgttgcaactatactgggtcatgctgaaattgtgaagcctcaacttcttcatgtgcaagagaaattaatgtactgtaatctcgatgtctgtgttgaggaccctccttgtaaattcaagtctctggcctctgccctttgaatggtaaacccccaattctgaacactcttgtatcctgctgaaattgtgaaagcaagctctgtatttagaaaatgcaatccctggaggtatcagtcaaccaaactctgagtaacttgccttccattagtttgatagctctgtaggaatcaagtgtttaaaatgtgtgggaattgtgtacataactcactataaccacctttcatccaggtgcctcagactacttcaccatagtcataaatcctgtcacatcccagtgatgcagttcatgagtctcttaatctagcctggtaagtaaaaaaattacagaggtcacatgaataatgactggaataggaaatggaccaagatagcaaggccttatcttgatcccctccctgttttaacaactttacatctgactgagtcaagaaaacctaaggccagaaacagattacaaagaagtcaaaatgaacgtaacactaaattctaactttatttatttattattcttggataaatggcagaatcctgaaaatgtgattctaaaaggaagtatggttgctggatttgcgtggtttttgtttgtttgtttgtttgttttttgagacggagtccactcttgttgcccaggctggagtgcagtggcgtgatcttggctcatcgcaacctccgcctcctgggttcgagcaattctcctgcctcagcctcccaagtagctgggattacaggcatgcaccaccacacctggctaattttgtatttttagtagagatggggtttcttcatgttggtcaggctggtctctaactggatttgtgttttaaatggaggagaggcctacttcagctcttacctttcctttttttaaagtggagaaaatggcttcaaagccctgtaaccctcactggaagtattctggacttgtaaaagcaggaaaaagtcacatgtctttttaccttttaacttaatagcagctgcctgtaaatgctgaagttcaaaacaagtaaagaaaattactctggtaatgaaagggttactgctattatagtgctgctaatccagttatgggaaagctccacattgccagaagcaggtaattaaacagaactaaaaagcaacgcaaaagaaaaaagaagtgggggtggggcgggtgaatcgagagcagctcaaataaaagagctcaatcaagtgtagaggaagtactttctagaggcacccaaacccacccaaatcaggaaaagccaggagctaaatttgtccttaagtacctggaagaaacataaggaaatgtctaaatgccacagcttggtcataaaaggaacttacccagggtgctagaaggaaagaagtggtatgtttatgactgcccaatggcagaccattcaggattcgaaaggttatcttccttcctgtctaaatgcatccaacattgaggaggaagtcagcacaaagtttgaaagagtgcatatatgttccagttctagccattccaaaagactcgttcctgaattcctgatagagccaactattgctaatagtcacatagaaatagtcttgtgttgcaaatccgcaggaactgatggccactttattatgcactgccttctaaatctagagaaaatgatataacggatttcacatgttggggccaaaatccaaagaaccttggatagccagcattgggaatatgagggagaattttcatgtcttcatttcttcacacactttcttgttcctaatgttttctgggcactttgaggttttctttatccaattcaaacaaccagatattcaaagatatccaattcaataatcaactccctaattagaagagtctagataatatatagaatccattcaacctggctaccctcatggtttgattttgagagccaactctataaggaaaactatagttttgttaggcaacattattcggtaaagggcggttcactctttttttcatatatatatatatatatatatatatatatatacagcttaattgacatataatccacctgttttaaagtgtacaactcagtggtttttagtatatcctcagagttgtgtaaccatcaccacaatcaatttcagaacatttcatcataacctcccgccggggaaaaaaaaacccatatccattagcagttgcttaccttctcgtcccagccctcagcaatcattaattgttctgcagtcactaatctttctgtcagatttgcatgttctggacttgtcatataaagagaatcatacaatatgtagcattttgtgtctggcttactttacttaacatttttgaggtccatgcatgtgtagcatgtattggtacttaattttcttttcttgccagataaaattccattgtgtagatagatataccgtgttttgcttattcattcatcagttgatggacacttgagttatttccactttttggcatttatgaatagtgctgttatgaacattcatgtacaagttgttgtgtggacacattttcatttgtcttggtagaattactgggtcatatagtaactctatggtttcactttttgaggaactgccagatagtcttccaaagtggctgcatcattttacattcccaccagcagtatatgagagatttactcttctattcagatgcttcctatctgctagctatgggaccctgtgccaagtgtacgtaacttaagaacacctccatttattgtctgtaaaatagggatagtgataatatctactttgcggggttgttgtgaaaaataaatgaagtgatgtgtgctaatattcttggtacaaagtcctcaatagttccccctccttctttttttttttttttcctcgagacagggtcaagcagtcctcccacctcagcctcctgagcagctaggactacaggcatacgccaccacaccagctaatttttgtgttgagacaagatattgccatgttgcccaggctggtctgggctcaagtgatccacatgcctcggcctcccaaagtgctgggattacaggcatgagccacagcacctggcctagttcccttccttctgtctgtagtatttgattgtcaacttttattctctaatagggagataaagatgaaattgtaactttatattaacactaagtgattcatacgcatagctggtgctgaataaacacttttcgtggataactgaaaacagcaatagaacttatattgttttaacaccaaaataaatgtatttctttctccctggtatggaactaatacctgagactataagaagagaaagcatagaaataagtcagcttttttgtttgtctggaattttcagatttttctgaaaacattttttatttccccacattttaagagtttcaaacatatagaattaaaagaatattctagtgatcacccatatgcataccatctagattcaacaattggtaatttttgcatgtttgctttatctatgtgtgtgtgtcttttgctaagctattttagagagctacagacatcaacacacttcactcctgaatactccaagctgctgcttctaaaaattttaccaattaccgttaccgcacctaagaaaatggagtatagttctctacatcctctactgcccagtcaatactcagatttttctcagttcacctcaaaatatctctaaagaagatccaatctgacaagccagctttgcttttcatcaatctgagcacctgtgactgtttagaatcactaacatcagcagaaacaaattatatttttgctgttgttttcagattttagctcaactggcacctctgttctatccagctactttctttgccttggttctgattaagcctgaggtagggagtagtgcaaaactgtgtgttgttgtttatgtgtgatgatattcaactaaataaaatggacattgattgtcatagacatttgttagctacctcctcgctattcttctcctcttcttctttctaataccaacttgaaccttgaataaacaggtggtctgttggccattgaccaggaatgggctccaccagtttatcctttctcccttagtgcttagtccagggaaggacccgtgagccacattgggccaatcagaggtaggactaaacatcagaggttttgactgagctatgggaagagcaaagtttctcttttctgctagacctaaaaaaggaaacctgtaatcccaggaatttactggcagctatctgggatacaaaaggaaagaaccaactgaagatttagccaacagaagaaagagaacctgagacaaaaaagaaaccaggacctggtcacagtgtaagagctctaagccttatctgaagccagcatgctgacctcctcactctttaatttatattacccaatagattaccttttttggcttaagccagtttgggttgtgtttttgattatttacagttaagagtcccaaggcattcaatccttataatttgcttgtcacccatccctgagtataatatgctgctatgaacataaggaggtaactaataataataatgttaagtacataaaaacacaattgtacagctccacatactattatgaaatacaaccatttaaccactatccagaaatataagcttgtccacatcccagaagaccctcacatgccctttcattcacagctgtctcactagccccaaaggtaatcattttcctgactttaatgtagtcactttcttttctttctttgaccacctaactatgaattcctgaaaactgtagtctagttctgcctgttcttgaatgctatataaattgcataaaataatcaagtattagatttttttttccttttttttttcttttttgagatagagcctctctctgtcacccaggcttgagtgcagtggcacaatctcggctcactgcaacctctgcctactgggttcacacgattcttctgcctcagcttcctgagtagctgggattacaggcatgcaccaccatgcccagctagtttttgtatttttagtagagacagggtttcaccattttggtggccttggacccctggcctcaaatgacccatccacctcagcctcccaaagtgctgggattacaggcatgagccaccatgcccagcctagatattcttttgtgactagctttttctccttaacattgtgagattcaattacgttctcgtgaggctacagttatttcattttcattgcagtatagaattgtcctatgaatagaatatgatttaatcatcctagtacttatgaacattgaatttatgaacattaaagtttcattttggagccataggtatggtgaatcatgctgctgtcaacatttttgcacttgccttcctggtcaccacctgtacatatttcccttgaattgctgggccacagggctacgtatcttcaactttcttaggtaactccaaactgtttttcaaggtgattgcagcaccttacttgcctaatagcaatctgggtcctgttgccctgtctcccagcctatgattggtattgtcagacttttaattttaaccattctagtggggtttttaacttgcatttccctaattgccaataaggttgagtactttttcgtattttgggggcctttttagatttcctttttgatgaattgctcaagtcttttccccagttttcccttacgttgtcctttgcttattgttttcttttgtaattctttgcatattatgaatgcaagtcctttgtcaattatgtgtcaagcaaaatgttctgttatgtagcttccctttttagtctcaaaatgatgtcttttgaggaaggtaaatttttagtttaaatttaatattttttatttgtaatgcttgttttaaacctgttttttctgtgctccacagcaccatctctgtcataaattgagtgtgcatatctgaatagatctgtttctgaactttctattctatcccactggtttctttgtttatccttgtgctgacaccagactgctccagtgactctaagaagctgatatgtggtaaagcacatcttcccacttggttttctttgttttgttttgttttcgggaggatcttggttctttgcatttccttatcaattttggaatcagcttgttgagtttcccaagatcgtgctgaggtttttagtttccacgtagatattttacatatctcttgttacattaattcctccatgcctggtatttttttatgcgattgctaatggtaatttacttttttttttttttttttttgaagaggagtctccctctttcatccaggctggagctcagtggcacagtcttggctcaccataacctctgcctcccaggttcaagcgattctcctgcctcagcctcccaagtagctgggattatagttgcccactgccatgtccagctaatttttgtatttttagtagagatggggtttcaccatgttatccaggctggtctcaaactcctgacctcaagtaatccccccatctcagcctcccaaagtgctgggattacaggtgtgagccaccccacaggccggaaatttgcattttattgtatgttaggctttgaggatgtaacagtaaatctcaagagtctctgaccccaagaccttccaatgtcttagagtgggggcagacacataaatgatgtgggttggttatcacagatatacaaagtggtgtgggttagttgtgatagaggtgagaaaatgttaccatgaaaatgcaaatagtgtgaagtgggtgggattagcccatttgtgggttcttgaggggatggggagagatattctgagtgttgaaaaatgcataggagtcagctgaacgggtgctgactcacacctataatcccagcactttgggaggccaaggtgggtggatcacctgaggtcaggagttcaagaccagcctgaccaccatggtgaaaccctgtgtctactgaaaatacaaaaattagctgggcgtggccgggcatggtggctcacgcctgtaatcccagtactttgggaggccaaggtgggtggatcacctgaggtcaggagtttgagaccagcctgaccaacatggcgaaaacccatctctactaaaaaaaaataaaaatattagccagacatggtggcatgcacctgtagtccctcccaactattcaggagtctgaggtgggacgatggcttcagcccaggaggcggaggttgcagtgagccgagatcacgccactgcattccagcctgcacaaaaaagccagacccagtctcaaaaaaagaaaaaaaaatcttcaaacaacccatggagagtcaacagcttctcacaatagttgatcagttataaaaagccagctagcttctaccagttaagataccagtaacagtggtgccaattgttcagattatatgaaattacaactcctatgtgttatatattctataatgtgaagcaacttgtgcaccctgcaaaccagggtcccttgtaaatcactgcatggagtagtttcatggagtaataggagaatcagtgatattgtgggtcctcttttatcaattatgtcacttaccgctgcgtatccatatattctttttaataaactgctatatattaaaaaaaaaaaaaaaaagacgtgcacccagaagtgaaagaatcaagtttaggcacctgccagatgcagacaacctgaagaccaccagcaacctgcactgccttagctggcttctgcccaggtggggtctgatgcagctgctggtgcctgggaaggatttaagtgggggagagagagcataaggtgaccacaggccctcacaagtgcagagaactctcactttttggatggagattgaggcatttaattaatatcttgacacatttctaattaccaaagccagactgattttttacttaaagtgagtaggagtgcccactaattaagaattcttgatatctgtccaagtttccactggaaggcagaaaaaaattactccttctgaatacttaaagggatagtgagtgataaaatcagattgcattttgattgcatcacaaatcttccgagttacttccagagtgtaaagttcatataagaaaggatatgcaaaacaattatgattggatctcagatttacagagggaatggggggaaagatgaggtaagctggggccagtccaggagttaaggagggacttttcatgccatgcgaaggagtttggactttaacacagaaatcagttaaatgctgaggagttgacttagaagagtaacatttagggcatttactatgttttaggtcctgtactaggtagtttacatgaattatcacatttaattatcatgaaaaacctatgaagtagatagtataattattgccattctaaaaatgagagaactgaggcatagagaggtcaagtaacttgtccagagtcacgcagctagcagcagcagaactcagatacaacccagacttgtcagggttctatgtgtatatcccccattatgctgcacctgcttcctgtcccactgataatgccaggatagatgatgagtttgttcacagagtgtagaactcaagccccactggtgtctccttagtaatgaatgaacgattattttacctgaaatgactatataaacaaaagacaataacacttcaggaatcttccctgtgagttatctttgtttttgtttttgtttttgttttttgagacaaaggctcactttgttgcccatgctggagtggagtgccatgatctcggctcactgcaacctctgcctcctgggttcaagcgattctgcctcagcctcctgagtagctggaactacagtcatgcgccaccactcccagctaatttttgtatttttagtagagatggggtttcaccatgttggccaggctggtcttgaactcctgacctcaggtgatccacccacctcggcctcccaaagtgttgggattacaggcgtgggccaccgcgccaggcccctgtgagttttctttgatgtctgatatggtttggctgtgtccccatccaaatctcatcttgaattgtggctcccataattcccacctgggaggtaattgaatcatgggggcaggtttttcccatgctgttctcgtgatagtgaataagtctcacgagatctgatggttttataaagggcagttcccctgtacacccactcttgcctgctgcgatgtaggacacgcctttgctccttcttcaccttccgccatgattgtgaggctcccccagccatgtggaactgtgagtccattaaacctgtttttctttataaattacccagtctcaggtatgtctttactagcagcatgagaacagactaatacaatgtctccacattgtttcacaaaataagaacgtttgctttgggtcatagacttctgagtagagtgtggctaattaattactctttctaaatgggaaatggaggtggcggctaggagagtgcagactagagttactctaactgggttcaaagcctggctctgcctcttaccagctgtgtgaccttggccgaggtactcaacttttctttgcctaatttcctatttaataacacctacctcacaggattttgtggtcagatgtgtcattatacatataaagtacttagaacaatgtcttgcacaaggaaagcagcattgctatggtctgaacgtttatgttcccccaaaattcatatgttaaaatctattattcactgcaatagtattaagagatggggtttctgggaggtgattaggtcatgagggctctgttctcataaatggaattagaggcttgagggagcttgttcgccccttctgccatgtgaggacacgtagaaagcactatcaccaggaacaggctgtcaccagacaaccgttgctgccttgatcttagacttgccaacatctagaactgtgagcaatatatttatattgtttataaattaccttatctaagatatgttgttatagcagcccaagccaggataagcactatcataattgttattattattatttttggcttatcatgcttataccttcactattcaaagatactaaagatactatcagtcagtatttactgagcacatattcatagcatctgttagatgctaggtgccatataagtgaattagaacacacaattcctgcaggtgctaagtgtgatgtaaatgaaccagaccataatttctgccttcaagcctgttatgacccagttagatagatggacctacgtatgctgccatgttataaagctgcatgatacatattttatcccttaattgattataaactctttctggcatgagccacagtttctttctttttgaatccctcgctccttctctcttccacttaggagattgtctatagtatgtcttcagctaatttgtcatcaacttccaaaaaacttattttatttgtttccttttttttttcaagacagtctcgctttgtcacctaggctggagttcaggcacaatctcggcttactgcaacctccacctcccaggctcaaacaattctcctgtctcagcctcctgagtagctaggattacaggtacccgccaccgtgctcagctaatttctatatttttagtagagatggggtttcaccatgttggccaggctggtctcaaactcctgacctcaggtgatccacctgcctactaggcctctcaaactggtgggattacaggtgtgaggcactgcacctggctgcaaaaaccttattttcaataaactttcctgctgaccactcctattaaggttctggtgctttcttcatagtgtctttactcaagtgttctcagcatcaagcttccaatccactgaccctaccagctctttacatcttctccttatgtcctgccatctctcttcacccaccataagttctatggtgtgtcatttaaatgtgccacttacaaggattcttggctctctgtctgctctgtacctgcacctgagtggctgatattgctggataaatcacacaaccaatcacaaatctcaaatctgagccttcaggcccactccacaatcccactgcattgtcctggtacatttgtttcccactcccagaggggcatgctctgctgtcttctcaaaccttccacaccacccatcctctctcttccactattttcagctgagtgagtagctgagaaaatcaaagtgatccatcaaatcccttgtctatccaccatgaaatgaccagaacgtagcggtattttaggccttctttcttgtaccgtggtagaggttccctggcttcaacaaaagatcagattctccactagcaatctgaatctcagcctcttgtttttttccagcatttagaatctgaaataaatccctctttctcataccatcaagtcccctctctactgggtcatttccactagcatagaaacatgattagaatggcggttgtttaaaaaatgtgtccaaacacggtggcttgcacctgcaatcccaacactttgggagaccaaggcaggaagaccgtgtgaggccaacagtttgagactggtctgggcaaccttgtaaggtcccatctctaaaaatttttttaaaattagctaagcatggtggcacacacctttagtgccagctattgagaaggctgaggcaggaggactgattgagcccaggagttcaaggctgcagtgagctatgattgtgccactacattcctgcctgggtgacagagtgagaccctgtctcttaaaaaaaaaaaaaaaaatcccccccttgaattttgtgcctcacaaccttcacctccacttcactacaaaaaatatcctgaaaagttgtctatcgcaactgcctcaacttcctaccttttattctccccttaatccattccaatcagaatttaaccccaaatatttcactgagagttttctagcaagatcatgaaagacttcctcaccaaatccagtggtcccttgtcagtactgatcttattctacctgtcaccagccatttcaaagagttgaccatctccccacctctttttgtttgttggtttgttttgtttgagatgaagttttgctcttgtggcccaggctgtagtgtagtggcacaatcttggctcactgcaacctccacctcccgggttcaagcgattctcatgcctcagcctcccgagtagctaggattacaggcatgcaccaccacgcctggctaatttttgtattttcagtagagatggggtttcaccatgttgaccaggctggtctcaaactcctgacctcacgtgatccacctgcctcagcctcccaaagtgctgggattacaggtataaaccaccacacctagccaattatctcccccttttaaaaacattttctcctcctgatttttgcattagatgcctaaggctgctgtaaccaatgactacaaattgaatggcttaagataaaagaaatttattcccttacagttttggaggctagaagttcaaaatcaaggtgtcagcatggccttgttccctctgaagtctttaggaaagaatctttcttgactattcctagcttctggtcactcctgccaatccttggtgttccttggcttgtagctgcctcactccaatctctgcctctgtcatcacatggcctttttgtaaggacaccagtcattggattcaggacccactgtaatcagtatgacctcatttgaacttattagatctaactaatcaggtctgtaaagaccctattttcaaatagggttacattctgaaattccagatgggcatgaattctggggagaatactgtttaacctgccagtttcggtgactgcatgccttcccagtttttcttctatctcattagctgttctttctcactctcatttgagggctactttgtcttagctgtaaatgttggagtgacccaaggcttggctcagggccctttcgccttctgtaaacacactgtctcctgaggggatatcgtccactcccatggttttaaaattccactaatgactcccaaatttgtgttccagccctcagctgtacccttagctgtgtccaaatcccagcctcctattgatgatagtagttaacacttattggacactccctatgtaccagaccctgtcttaaggtctttatatgtattaactcatttaatcctcacaagaaatttacagggtgagtactgtttttatccccaattcatagatgaagcaactgaggcacaaagaggttaagtaaattgttcaagcctacataggtgggagccaggttgagtccagagtctgctcttttcaccaccacctgttctgcctttcctctgggatccaggcttatatatcccaacacatactcaacatctgcacccagatgtctaataggcatgttggaggtgaattaaatagaacattggactcctgcccgttacctccaccttaatctttcctttcctggtcccacatctcagcatatggcaccaccaacccagatctagaagtcaagttcaaatttgattctcctgtttccccatttaccctagtcttcattcccgtgcccagccagtccatcagcaagccctactggcttgacctcaagcataggtctctaatctgtccacttctctccattttcactaccatcctagttcatgctgagctatcatttcatgttactgcaattaaattctagtctttttgctttcacttttttggtctatccctaacccagtggctagatacatttctgaaagataatcagaccatgacatggcccagtttcagagccttccaggtgtcccttatgttcaaaatgcatactcctgttccttgcccacagggcccagcctgacctggcacctttgcctctctgctctcctctcttaccacactcctccttagttctccagcttgagtcacaggcttcatttatgcttttccaggaaccccaacccatgcttgcatcaggccctctgcacctgttcactctcctgacaaaaatggtagcagaaatgctccatcctcacatcttcccttcattcagaccttggctcagacatcacatgctcagacaggacttttctgaatcactgctttttttttttttttttttttcgagacaaggtctcactctgtcacccagactggagtgcagtggcaccatctcggctcactgcaacctctgcctcctgggttcaaggattctcctgcctcagcctaccaagtatctgggattacaggtgtgtcccaccattcctggctaatttttgtatttttagaaaagagggtttcaccatgttgtccaggctggtcttgaactcctgacctcaggtgatccgcccaactcagcctcccaaagtgctgggattacaggcgtgagccacggcacccagcctaggactttcctgaatcactatctaatgttgttctgttgtcccctgatcactttctctcacacactgtcccatgttttttgtttgtttttcctttgagactgggtctcgctctgtcacccagcctggagtgcaatgccacaatctcagctcactgcaacctccacctcctgggttcgagcaattctcctgcctcagcccccccgagcagctgggattacaggcacctgccaccatgctcggctaatttttgtatttttagtagagatgggttttgccatgttggccaggctggtctcgaactcctgacctcaagtggtccacccacctcggcctcccaaagtgctgggattacaggtgtgagctgttgcgcccggcctgtttgtattttaatagcctttatcactatttaaaaatacctcattcatgttttatttatttggacggagagcttttcatttacattttatccccagtgcctagaatggtgtccaatacagactactcaatatatatttttaaagggatgaatgaatgaaactgagtgtacagacaagtgaggtcaatcatgaggttgtttatggatcagttttaaggcatagtttgaaagaggggaagatgttttattatagtggagaaaggacatttttagcaaagaaaacaatatattcaaataaatgatctggtcttgaataagtgacagatagaagctgataactgtattaattcaggtgatatagaaagttggtgactacaagaataaaattagcttatgagagcagggagttatcacttagatattgaatgtcaaactaaggagtttaaattcattaatgacttcagcaaatctttattgattttcttttggatgcagatactgttctaggtactttttgtacaataatgaacaagcaaggtataatccctgtcctcatggtatttacagtctagtggaaaactgacatcaaatactattccataagcatttatacaaatggtcaaagtgtgtgctgagttaatattttggaaaattactcattgtgtgttttgttcccagcattacttgttctcctttggctcttacccattcaatcagctcagtattctgcatgtaatgatgcagaagatagatgaattgcagaatccaatatataactaacaaaaaccttatcctagctcttgagttccaaaattccagttttcagtaggcatagaatataacttctgtcatgaatagtgatttgagaagatactcactgaatcagagcaaggctattctggcccagagactggcaacttttccccaggatagaggagagtcagagggaagtgattagaacttaggtggtgttgggtctttgcaaaatggagcctccaccccatctcatttcccaggccaacctccaggggatgacaaattcaagattagtttggacttcataagagcaaaagagactggtgctcacattctccaggcccagcccagcaagttgaccaacactgagtagaaatggctttgtagaagcctttgcacttggactttgaaacctcacagattccacctgtgcttctctttggtgcagaagagcaaagtgatctctaggcacacaggagcagtgctccaatgaagcacagcattgtttttctgacagcaaatctgtcattttccaaggaccaccaattctccaattctttgataccaactgggtgtccaataattcaattcaactctgacaccaattacctggagtcagtgcagaccccacaagttatgggttcagttgcataacaatgcctccacttcacatgttagccggatatggggctccaagctaactgaacctctgctcaatcaactacaaatttggggattcccatgaccctccctgtattagttcatttccacgctgctgataaagacatatcatgctgataaagaacagcatggaaaagaactgagcccctgattcaattacctcccaccacgttcctcccacaacacatggcaattcaagatgagatttgggtggggacacagccaaaccatatcactccccaccctccaccaggtttgataattcgctagaaagactcacaggacacaggaaagcactatacttaccactgcagttttattataaagaatacgattcagaaacagccaaatggaagagatgcatagagctagcaagggagtggaaggtggacagaaagcccatgccctctctgggcatccacccacccagcacatcaatatgttcacaaactcagaacatccctaaacgttgttgttcaagagattttactgaaatttcattatgtaggtgtgattggccattggtgattgaactcaatctccagaccctcttcccctctccacagttaggggttaggggatggggctgaaagtcgcctggtgatcagctctattctgaagctctctagaggttaagaattctctcattagcatgtggtcaggtatgattcaaagaggcatgttatgaattacaaaagagtcctattaggaaattctaaaggtttagaaacccttgttccccgcgtaactactccacccaaggcaagtctcaagctgtccaacttgatgtcactgagttcacctggaacccagatgaaatatcaggaggaaagggaagggtgagtactgactctatatcattttcaattcctgttgaataagggttcaaattgtaaattaaagcctactcttcctttccctccctccctcccttctttcctctctccctcccttgcttcttctctcccttccttctttctttctttctttctttctttctttctttctttctttctttctttctttctttctttctttctttttctttctttttctttctttctttctctttttttttcttttttgagatagagtcttgccctgtcacccaggctggagtgcgatggcatgatctcagctcacagcaacctccacctcccaggttcaagcaattccctgcctcagcctcccgagtagctgggactacaggtgcacgccaccacatctggctaattttttgtattttagtagagatggggtttcaccatgttggccaggatgatctccatctcctgacctcgtgatccacccgcctaggcctcccaaagtgctgggattacaggcatgagtcaccacacccagcctctctttctttcttttgttcacaaagtcaacagtggctgagtgcccatgtgtttcacggtgcttgtctagtatatttttaaaaggtggcaccagggcgcttctgctaaaatgggtctgttgttcatggaggagctgggagtaatggctctggaagtgtggggagaccaacagctgacagggatcagccctttcagtccaagtgggacactgctgcctacattatcttcctcaccttcgtcagcaccctgttgttcttgctgttgctcattatcatccactgttgctgcagctgctgctgcaactcccagaaagtgagcccccagaacaaaaaattccagtagggtaggtaacttggcccttgtaccttaacaccatgagtccctgccagccccttcctgtatgtcttgccttgtagcaagtaacaatcccatgccttgtgtttacctagaaaaattaattaaattaatggtgagtcacatatttagaaaataagagtttttgcagacctgcgtttgtagattgagatccattcctgtcattaagactgatcttgccattgtaaatagagatatacaaaactacaaagagatttgtggaatcccaactggattctatttaaatatcaataagagctgagcctggcctgctcagaagaataagaagataatttagaataaaataaagccattgaaagagtaaatcaatccaatctcaaagtgaaagaacctaggagaggggttacagacccagatttcactagaattagggacgtgaacatgggaccctttctggctatgaaattcctgtaactaggcctcgtaactgggcctcagtatgttgggagaacacaaaaccctgagtcccagccaaatccagagtcaatttgtatcctcagtgacctcctcctgaaaaataagaccaaatgtttggtgtggtataactgtctgcttcatctgcccattttaattctaggaggatctgtaattgaaaataaaagagtgaattatgaaaactgattaagccaaacccatcgtattcatatattcatggtaagttgagaaacaccttgtgcacttgctatttagaatacgtgtaattatttggagaatttattaatagcagatgagcgaatcaaacagaattgctttataatttaatgtataatatttaattgaataattgattaacttctgactttaagttcaatgtataagaaaactttactaaatttaaagatactattggaacattcagaagaacctaatattcaccatatttatgtttcatatgttagagttacttaaattatttttgttacacagttgaatgacttaaaatgaaaacaagtacattaaatgtatgaatgtaattttttgatgtttaagaattaaaattgtccagcgtggtggctcacacctgtaatcccagtactttggaaggccagggcgggcggatcaccaagtcaagagttcgagaccagcctggccaatatggtgaaaccccatctctactacaaatacaaaaattagctgggtggtggtgcgtgcctgtagtcgcagctacttgggtggctgaggcagaagaatcgtttgaacccaggaggcggaggttgcagttgcagtgagccgagatcgtgccactgcgctccagcctgggcaaaagagcgagactccgtctcaaaaaaaaaaaaaaaaaaaaagaattaaaattaagtttgtaaatgggctcacacattaatcaaaggcccccttaaaagtgactgttaaagtcttatttattcattaatagaacaatgtgatttttattttgaattttaaagcttaaggacaaatagtcttttgatcttataaccttaaatggaatattaatttctaaaaaccaaactcatcataaataatcttttctggtcataaaaactgccatcactcatacctaaacccaagaatcactttcttatagtgatgatttaaacagatgcaaacagcgagcacatcttgtcacctttgcgggactgtggctgtgcccctcgcagtaaatttggaggttctacatccctggtgaaaaacaaaacaaaacaaaaaaaaagcctgccatcattgacaccaaaacactcataatgacagtacccactgtaatgcttagaagtgaaaaaataacatgccatgaaagagactaattgaaggggcttaatttagatcaggggttcaaagatctctctggaaagtgccttgtgagcagagacttcagaaagaaagtttaaccaaaggaaaatcaaaaagaagagtggtccaggtgggatcctagagagagcttagtatgacagaggaattgaaggaagttgggaagttcagagaagctggaaccaagtaagtcagagggagagtggcatggatgggacaggagaggaagctgcagtcagatcatgcaggcctttggagaccgggttaaaccatatgttatataaacacaaatatacaaatccctaaatgtaatggaaaacctctgaggattttaagcagaggtcggggtgctgagtatggttgaatagcctgcgtactgcacaactccatgttgcaccagtggcatagttcctggtgtgatgcaatattgcctctgggcaggtaacacaatcaaattagtgttaaacaattactctggttgctgtagggagaagaactgtagaggtaagagtggaaccaaggagatcatttaactagctaatgcagactccaatcaagtagcctaacacagtatttgtggtgatagggaaaagtggacagactgtttttttttttctatttccatggcagacagtagaagtctgggtagatttctgaatctgaaaataacctatcttaaatggtgcttgagaaaaattaatcgtccatccagaaatgtgctagagctgatatacagcagcttgtattggttcagtagagacaatggggtccacctttccccaactcctcattcagtgacatcaagttgatagcttgaaatctgccttggtgggagtatttataccatggagattagcaaacactaccaatagagcttctttccccagagagctgattgtgaaacatttaccagcacaccagtgcttccagtgcttttcgctatctcaacactggaatactatttaaagaatcactgcatataatatgatatgatgtcaaagaacattcatatggttcttacgaaaccttaagaaaggaatggttatgagagacactgggaagaaaatatctgtaagactgggtggtgctttgcaaatggtggtaatgggaagagggggagcagattgtatcttcttccatggaataggaatcatttcaaagcatatatctttgatgaagattacagagagaacatttcacagtttggttccctgtcctctgtattttaaatgtccctgcttctgctgtcaaggatttcaagtgccttttaaaaattccatattgtggtagctctgagttctgaattctatcactatttactggtgcagttaaatgaataaaataataattgaataccagactctcagtcactgtcttgcagaaacagaagctctgcagagagctggagaagagcatgcttcaaaactgaaaaatgtcttccactttgtaaatttgtagcatcaaggcagtggtgttgaagaccaacctgagccttccatatatatgtgaaggttcacataagggtttctaaagggtaccaggaaaggaagtggagggagaccctaagggcatgctccaaatattatttttcccatgaaaataagtgttctgcagaatttaaagcttatatcacaacatgatgtaaacacctttctcatcaatattgtgacaagtattttcctagatcccggagatatgaaaatgaataatgtagtgtttcctcggatctcagtgaataaaaaagtgaataagactacttcatttggcacacagtaattgagagagacaaaatcatgaacagattaattagagtacgatgtggccaatgcagaaatttagtatttagaagataccatggaagcccaacgaagggcatgtgactcagccttgggtgagcaggggcagcttcctgggggaagcgatatttaagttgaatcttaaagagtaggggtaaaccagatacagtgtgtgtatggagtagagggaattccaggcagagggaagagcatgagaaaagacacagaaatgagaaacaacaggtgatttggccttagaggcttggctgaagggaagatggggataaggagaggagggtggaggcctccaggttttcagtggagtaccaaggagtagggcaatttgagtggaccatgctgggtgtaggcaaaaagggggtagactgtctgttgagtattagaaaacaataataaaactgactatattgccagtgattctaaacaatgataacacgctcctctctatcaaggtggctaccccctgggtacaccactgcatgtttttcctgaaggtctggggcaaggaagtgatgcagtcagactcctgagctgtgcagatctggagatgccagcctcaataatatctaagtgagagaacattttctcgcatccccctccccatcctagacagatagagagtgcctctactaaacatcctcaaagcactgagcatttttccataatagccgagcagtttgtaattatatccaccactgaagagaaagaatgcaagagaaaaatacaggttttcggaagatatatagagtttgggacaagtttagttttattggcttgtgggagatcaaggacagatacacagcaacaggacatggattttggactaaagctgtaggttcagagtcattagcatagaagtggtggttaaatccttgggagtggatgaggtaacctgggaaaaactgagaaagacagtgggccaaaagtggaatgctagaagctgaatattctatggacagatgatggaacaaatatccaaaagaaaagacaatgaagaaatgctcagaggcctaagaagaatctggacaacacaaaattgtggcaagattttccaggaccaaaggaagagaaagaactggagataatgcagaaaactaaaatatcagtaagtgtctgtgagaaagaagtcaaacccatggcatatgtgttggaaggaagttggtgagaaaatggggaagcaatggcggaaaccttggaaaaatctgggaatgacagaatcccatctaggattctccagagggacaaaactaataggaaatatgtctatgtgaaagggagtttattaagaagaattgactcacacaatcacaggtaaagtcccacgataggcagtctgccagttgaggagcaaggaaatcagtagtggatcagtccgagtccccaaacctcaaaagtagggaagccaacagtgcagcttcagtctgtgaccaaaggctcgagagccccttggcaaaccactattgtaagtccaagagccgaagaacttggagtctgatgttcgagggcaggaagcatccagcaccggagaaagatgaaagctggaaggctcagcaagtcggcttctcccaccaccttctgcctgctttattctagccaagttcgcagatgattgggtggtgctcacccacattgagggtaggtctgcccactgggaagatttccctttgccactgtccttcagggatgtcctagaaagagactatagtgctgcacctgtccacttttgggtggtacctgcatatcgtgcagaaccacccgtaaaccaggccctagtcctctcttcctgtgtagactgatcgtaaggaattccccatgaggccatcggtgcaggcttggggagagaagacagggtggcaggagtggagatcatgggcatttgagccatttccttatgtaacttacttgtgccttctaagcagctcaggtcgcatggtgacttgatgacccataatcaagccttcagtttctaccaaagcccagtaacaagccaagagctgtgtctcaaaaggagagtaggtatctgcagaagatggcagggccttgctccaaaatcctagaggtctctgctgtgattcacctatgggggctggccgaaggcttcgaacagcatcccatctgctactgacacctcaagcactgctggatctgctgggtcatatggcccaagtgacagagcagcttgcacagcagcctggacctgttgcagagcattttcctgttctggaccccactcaaaactgacaaccttttgaatcatttgataaatgggctggagtaacatacccaaataaggaatgtgttgcccccaaaatccaaataggccaactaggtattgtgcctctttcttggttgtaggagggaccaaatgaggtaatttattgttcaccttagaagaaatatctcaataggccccacaccactggactcctagaaatttcactgatgtagaaggtctctgaattttagccgaatttatttcccatcccctggcatgcaaatgtctcaccaataagtccactgtgtttgctacttctcactcactgggtccaatccgcataatgtcatcagtagaatagaccagtgtgatatcttgtggaagagaaaagtgatcaagatctctgtgaacaaaattatgacacaaagctggagacttgatatacccctgaggcaggacagtgaaggtatattgctgactttgcaagctgaaggcaaattgcttttggtgggccttatggacaggaatggagaaaaaggcatttgtcgaatcaatggctgtataccaggtacaaggatatatgttaatttgctcaagcaatgaaaccacatctggtacagcagctgcagttggggtcaccacttggttaagcttacagtaatccactgtcattctccaagatccatctgtcttttgcacaggccaaataggaaagttgaatggggatatggtgggaatcaccacccctgcatctttcaagtccttgatggtggcactaatctctgcaatccctccagggttgtgatattgtttttgacttactatttttctaggtagaggcagctctaatgccttccatttggccttttccaccatgataggcctcaccctaccagtcagggagccaatgtagggattctgccagctgctaagtatgtctatgccaattatgcattctggcactggggaaatgaccacacaatgagtctggggacccactggacccactgtaagtcggaccagagctaaaacttcattaattaccttatctccacaagccccataagatccgtattttagctaaccaagctttaactggaggaccacaatgatgttttgggtcctctgaaatcaatatcagctcagagccagtggccagaatccccgaaagttctgatcattcccctttccccagtgcacagctaccctggtaaaaggccagaggtctccttagggaaggatgggaaaaagattaactgcataaattgttggtagtatagtgaggttcttcctcaaggagaaccggcgtccctttcattcaaggatttctgggtctgtaaactggttcatgtctggaaatgattgacaggccgtaattctctatttttataattcaaattagtcttttgtccattcagcctgaaagttttctgcttatataaattaagtaagcatgcagtaggcttcctatcaatttcacttctaggaacactgtgattaattagccaaagccagagctctacataaatcatgctattctgattgctactttgcctttgctgtccattatagtaactacatccaccttgcctttcatggttgagtgcctcaacttggcccctgccaccttgggatccaattatttccattgcatttaacatttctaattgagtgactgcagttcccactgtaagatctggcatacaaagataagcaatcacaaaactcttcaaggatgtaaatgctcccttcacaaatctatttcgcaaagtattggtgaagggtatatcttctggaccctcccagctgggatgagtaggtctaaaatgactaatccactccaacattccaatctccctaagcttttggatcccttcctctacattaaaccaagggagatcaggcatttccagcctactcatagtaggccatattttattttattttattttatttttttgagacagagtctcactgtgtcacccaggctggaatgcagtggcacgatctcagctcactgcaccctccacctcctgggtctaagcaattctcctgcctcagcctcctgagtagctgggattacaggagtgtgccgccaagccgggctaatttttgtatttttagtagagactgggttttgccatgttggccaggctggtctcaaactcctgacctcaagtgatctgcccgccttggtctcccaaagtgctgggattacaggcatgagccaccacgcccagccaagtaggccatcttttgatccatgtttcagctaaccaagcaaataaattattagaacctttttttaactccctgatctgcaacattaaatgcagaatccctgcttagtgggtccatatcagtaaattcagcctgatccaactttatgttctttccaccattatcccatgcccttaaagtccatcccgatacctgttctccagatttctgctttataagttagaaaactctgttcttttggagtgtagcgcacctcctcattggtcacactctgaaccttacatctagagcctgctggaacttgagtctagttataggtctggaagcaaacaggggtgttaggggtgggtcctgaggagaatcagcattctcttacctggcaacttcctcaggggaggccatcactgttgcctcaggcagtgcagggttaatctcctcagacaaaggtggaaaggctgatggcagcatgggtggtggggggagatgttgctactgctgcagatgggaaggctgtttcctctggcaaaaaaggctcatcagaatttagaagctcagtgtcccaagcctcatcagggacctcctatacatccccattcctaattgcagggtcccattcttttccaatcaatgccctcactttaacagtagacacctggcaagggtgtgcattcaccttttattgcaagtcagccactcacatgataagagcttgtgtctgtttttccacaatttcagctctttctatacaggagataaaactctctgttagggcagtcttagaagatttggggctcagtatctgcttctggagccaggagttagaatccctgagttcatcgttttctttcatcactttgtccagcaaacttaggagcaaccaaacaactttatgacattccttgattctccacatatggtcaaaggtattatgtatagagtcactaaactccttgcctctgcagagcagtgaatcaggagtatcaaatgcatttattttgcataactttctaaacagttcacaccaaggactatcagtgttttccatagtattcaaagcagaggtcttagcatttttgggtctaatcagattgagcagccaattccagaaaccctgaaaccaactaaagaactctatccttaaaattcttgaaccactccaggaacaaaatctgtattagtcagggttctctagagggacagaactaataggatatatgtaaatatgaaaggcagtttattaagaagaattgactcacgcgatcacaaggtaaagtcccacgataggccgtctgcaagttgaggagcaaggaagccagtagtggatcagcccgagacccaaaacctcaaaagtagggaagccaacagtgcagccttcagtctgtggccaaaggccagagatcccctcggcaaactgctagtgtaaatccaagagtcctaaagccaaagaacttggagtctgatgttcaaggtcaggaagcatccagcactggagaaaaatgaaggcaagtcaggttctcccaccttcttccgcctgctttattctagccaagttggcagttgattagatggtgctcacccacattgagggtgggtctgcctttcccagtccattgagtcaaatgttaatcgcctttggcaatacactcacagacacccagaaagaatactttgcatccttcaatccaatcaatttgacaatattaaccatctgatggtgtaagtggatctatgggcccctgcctaagtcacatattgagccctgcaggtgacaagaccccagagttttcccacagcacagtgtggtgaggaatacggtagtcatggcccagtgtggctgaggggcctagtgagtgtttcccttccctcaaaaacagaattggcccagcaaagagactcaccagactagaaaagacagggacttgtgttgacagatgggatcatgcagatcttaaggtcagctaggatgatggccatcttaaaagataccgttgtcctaagacctctggcccggatgcattctacatgaacctcattaactaagcctctgcccacacctacctcctcttgaatgttatctcaagcagaaaacttagttgcctgaggccaagtgtctgccactgggaggacaataacaacaaataaaaatgaagatagagaaaaataaagtaatatttcttgtgtacttcagtttgcaaactggaacccatatgctaattgtagaaaaatgactttataaatcctggactcattgaatcctttctctgtatgctgttgatgctgcattcaaagaagtacaatcccaacagctaaaaatgataaaacatgaaattctgagctttcatgtgcattacttggaaattgtttaaaaggatcccatttgtaaccccgagaatactcttcctatgctctcttctctcttccacaattctctcacaccctgtattgctttagagcctctcattcacaactctacctccccaaacctttttctcctacagttcacactatattttgcttcctaaattcatgaatctggctgggcacgctgtcctgtattcctaatactttgggaagttgaggcaagaggatcccttgaggccgggagttctagactagcctggccaacatagcaagaccccaccactacaaaaaaaattagccaggcatgatgaggcaccactacagtcctagccacttggaaggctgaggtgagaggatcatttgagcacaggagttcaaagctgcagtgagctaagaaggtgccactgcatgggtgatagagcaagaccccatctcttataaacaaacaaacaaacaattttttttatcccctagttctttaatagatcatttatgttttcttttctcctgtcctttccccttttttcctattctttcttcctccttcccgaggtatggaaggattgtgaatctactcagtcaatcttaaaaggggcaatggggagagggaaaacaaggaaccctcacaggctaatttttaaaccacatctcttaagaaaatatggagaagcaaagagaggaaaatgtaaattacctgaaattctaccactgtaaatatgttgatatactttcagactttttcctatgcatttataacacacacacacacacacacatatataagttgcaaaaaatggccaacagtatatatatacatactcttttgtagtcccctttaagcaacttattgtgaatgtctttccctctcaagctttatactgacaacatcattttgaaaagctacatgactttccattgtgtgaatgtactatcatttatgaacttttctttcactgtaagacatttaggttgttttctctgttgtaaatgataaacactgctgttgtcaatatccttatgataactcctttgcttacttgtgcaattatttttataggatcagttactgggtgtgaaaattgggatggcaagcgtgcatatagcattcactttctagggctgctggaacacagtaccacaaactggggagcttaaacaacaggaatgtatggcctcacagctctggaggctaaaagttcaagatcaaggtgtcagcaggattggttccttctgaaggcctgtccgcaagctctggtggtttgctggctctctagatgctccttggtttctgctgcatcacctaatctctgcctccatcttcacatggtcttctccctatgtgtgcaaatttcccctttttgtaaaaacaccaggcatactgagtctgagacactgtggaacatgcaagcggaaatatctactcagtagctatatatgtaggtctggagtttaggaaagacaaatgtgtgagtcattgccacttcagtggcagttgacagtcatggggatgggtgaaatcacccactaagatcgccctgtaacatgatataaaaagagagccaaggaaagaattctaggaactccaataaacttacaggatgattggagggtaagaaggtcactaatgttgcataattagacctgggcttcaggaagtcagcactgggagcgatattatggaatagttggaattagaaagaaagaggagacatgtcccatctcctagctctgaagcaccctgtgtgtccattcctgacttcaggcacctccctccctgccattggcagtcactgctcttaagtttttattaaccaatctcttgcttttctttatagtttaagcacatatatatctctaactactatgttgttcaattttttctacttttaaatgttacatacatggaatcttgctttatgagttcttctacaatctggttatttactcaaaattaggtgttttggaaggatttgttttgtcacgtgtggctatagatttttcatttttagtgctgtatggtattgcattgtaggcacatacaccaatttattattattattattattattattgaaagtaatggcaaatactataattacttttgcacaaacccagtatttgtccactgtattattcatggacatttggggacatttccagtgttttgctattatgagtaatgtttccatgaacttgttcatacatttctccttcatctgcccaagagtgtctttctagaaaatataccacagagtagaatgtttgaatcgcttacccccaggcttgctttacaccagaaaagactcatatgaaaatgaattcctgcctcacaccatattcaaaattcaatttcatgtggatcaaacactgaagttccaaatgtaaaccttaagactttcaagagaaaatatgaaaattattattttttacattttgagatggagtttcactcttgttgcccaggctgcagtgcaacagcgcaatcttggctcactgcaacctccgcctcctggtttcaagcgattctcctgcctcagcctcccaagtagctgggattacaggcgtctgccacaacgtgagctaatttttttgtatttttagtagagacaaggtttcaccatgttggccagactggtcttgaactcctcacctcaggtgatctgcccgcctcagcctcccaaagtgttgggattacaggtgtgcgccaccatgccaggctggaatatctttatgaccttaggttaagaaaggttttcttatacaaagtacaagaagaaccacctgtaaagcaaaaggtaataaatcgtaagaattaacaacttcttttcaataaaagacatggtaaaaagaatgaaaagagaagccataactgggagaagatagtcatataatatatataatgcacaaaaattagtatctagagtctatgaataattcctacaaatcaataaggaaaaagacaaataactcagtagaaaatgagcaaaaggctcttcacagaagaggaaatccaaatgccgagaaacacaggaaacaagattcagtctcattagtaatcagataaatgcaaattaaaaccacaatgagaaactgtttaaatccaccagactggcataaacgtaaaaataagacaataccaagttttgacaagaatatagagcattgtaaactcacacactcctggtggggttgtgatttgctacaacaactttgaaaagcaatttgtcatcacctagtaaagtcaagtaagcatgtgtcatataccaagcaattctacccctaatgttaaactaaaaaaaaattctttgtacatgtgaagcaagagacacaataagaaactccattgcacaatagcccataattgttcctaacagcaaaaaacattgacacaattgaaatttctattgacattaaaatggattacaaaactgtcatctatccatatcatggaattttatacagcagtgaaaatgaatacactgcaactacacataataaatggatgaatttcacaacacagagtgaaagccaagtagtaagtcacagaaagtcacatatgatgtgacttaatagatgtagtttaaaaaacagacaaaatcaaataatagtttgtttagagctacctacatgtgtggtagggtctaaggaaaacataggcttaacacaaaatttaggataatagctacttctgggtggaggtgagcatgcgacgataaactatgataaatatttgaaggaaaggctggagcttatttgaagttcataattaagggcctgactcaagactgtggattacaaaagccttcctgaggaagtgcacgtcagctgatacctgaagcgtgagaaacagtttagagcagtgcttctcaaaccttaacagagacccccaccaattgctatgggatagaaaggtattttcagtcatagtcagatttttgattattaaaatagaactttatccaaataaacataaagtactgactattggattttctgccttcctggaggaaaaacatcatttttttttcaagcttagcctcattcgaatagaatttgaaagatttcactctgctttaatggaagccagacttgagaacaaatgataatatatacaaaaactggtggccataagcaaaaaatctggaaatatccgattgtttactctgggttaaaagagattatgagagagacctggtcttcagaaaatgcattgaacatccaagttcaagtagctgcaacaaaagcatcctttaaaatatatcagataaattttaaaaaaaacttaaggtggcaataaaagatggcctggatgaaagcatatttttgtaaaagcataaatctgctttcacaagaagctaagataaaaaagagtgagtaaagtgaataaactgaaaaaaacttgcagaagatgaaagattgagctgctgttcttacataggagaatgagatctgggaattggagatattaacaatgcctcagacaatggagattgtgttgaggattaataaagttttttattgaggtaaaattcatttaaaaacactgtgaagtatacaaaccagtggcttttagtacattcacaatgttgtgcagccatcactactatctaacttcagaagatttttgtcaccccaaaaagaaactccatacacattaagcagtcactcccaattcctgcccccacttccacctggtaaccactaatctatgttttgcctctatagatttgcctattctagacattttatataaattgaaacattatgtggcctttcgtgtgggttctttaacttaggatagtgttttcaagtttcatccatattgtagcaagtatcagcacttcattccattttatggctggatgacattccaatgtatgggtctgccatattttgttcatgccatttatccactcatggatatgtagcttgtttccactttctgcccattataaactatgcctactacgaacattcatgtataagattttatttgaacatatggtttgattctcttgatatattcccaggtgggtaatttctgggtcatatactgtagtaactctgtctgaaacatttttaggaaatgtttttttttttttttttttttttttttttttttacagtggctatactattttacattcccacagcaggttttgagggttcaagtttgagttttccttgccaatacttatttcgcattaaaaacaaaattattgttatagccatcatagagggtgtgaggtggcgtctcactgtggttggatttgcatttccctaacaactgatgatgttgagcatctttttacgtgcttattggctatttttatattttctttggataaatgtgcattcatctcctttattcatttttaattgggttgtctttatgttgttgtaagagttctttatatattctgggtactaaataaacctttattagatttctgatttgcagatatgttctcccattctgtgggttgtcttttcactttcttaataatgtcctttgatgcataaaagtttttacatttgatgaagtccaagttttttctttttcttttcttgtgcctctagtgtaatatttaagaaaccactgcctaatccaaggtcatgaagattaacatctatgttattaaaatgaagttctgaagaagctggatttatgtggctatggtaaatgtatctttaaaaactcttgaaggaaaaagcaataaaatctacactaaattattgaagaagtcaaaataacaaatgcacttatggataatgttaaaagtctcaaaaatgtactagcttcattgcagtctgaaaaatccagtttgaaagtgagatttcagagcttcagcagaaacttagtcattactaaactgcatcaataaaataaaatgattatgcaagattcaatttaaagtgatttactatggaaagagaagaatctttccaaagcagatgaaaaaatcagtcatgcatctgaagtgctagacatcttcagaatcctagccaaaattctctctctctctgtctctctctctctctcttttttagcagggcctctctctctctgttgcttaggctggagtgcagtggcatgatcacagctcactgcagcctcaacctcctgggctcaaatgatcctcccaccttagcctcccaagtagctgggaccacaagcatgcaccactatatgtagctaatattcttttaaattattttttgtggagacagggtctccctgtgttgcccaggctggtctcaaatttctggcctcaagagatcctcctgtcttggcatcccaaagtgttgggattataggtgtgagctaccacacccagcccaaattaaaattcttctagaaaaattagaaaaagccattggatcctatcaattatcatgaggaaaaaaaagctcttgatagttggttgagagctctattggctgagaaaaactttgataactcaagaaaataaaatccacaactcagggaaataatgatttaggaagaacttaagtttcagctttttaaaaagtatctctatgtccctgatattccaaaaggaaaatttggcagatgcatgggagatactaggatcccctgataccaagacagcggagcattaggttgggatggctcagggttccaggatctgtgcctagtgtggaccagattcctccatcaggccaactccatcaggacacataaattcctccacaacaacagggagagtttctcctggtgctcctttgctgccttctttcaatgatattcaatgctcaagatcttcttttgatgatgttgagagacatgcaccttcagaagtggagaccaataggaaagacaatgcacatgatcttggtcatttaattacaccagactcaacccttccatctggacaagaagcagctgcccaggctctgttcttctacctcatcctcctgtcagatggcacagatgtgtcccaggggaatgttcctgagaagcaaaccttctgtcatgctctcttctctggaaagccatcatggacctcctcaaggattctttccttggggatggccacggcccagcacatccttctctggccacaagaaacatgtcttcacaagtgctggattttgtcttctgttcacacaacttgaaaacagaagcaatgcaccttcagaattgatcctgcctcccaagaagcctacttccaaagatcagaatcataaaatgcatttttgctgtcttcgtaagcaattttgatattttgtcagtttcattgctattaagtgatcattccttgcttcaaatgaaagctagagagaattacaattcttatgatactgttttataactgtagattacctatatgtgaatttttaagcaaattgtttccattttattctatttgtatgtaattatactatttttgttgttaagtccactaaaataattcagaaacacagcaaaaactttgtcttctaagatatttttgaatattttctcttttagttttattgctcttaagtgattatataagtactcaaatgggaacatgatagaattataattctcaggagagtgttttacaaacacacatcatataaatggaagttttgttagtaaattgcctccattttatttgatttctgcataaagtacattcttttcaacattgctatttaacaagtctcttctgttagtccagaaaaatggcaatagttttatcttctaaagtatttttcaatttctcttctttagtttctctgtagtagttatgggattacacaattgctcaaatggaagctcaatagaactatcatttttaagatagtatttatgaatttatttttaagtgaattttattttcttcaatctctagataacatgaagacagcatttcaattgctgatgtttaacaagtccccagtaactccaactgtagttgtagtaagagcagttgtgtaaacacatggagacatttgaaattcagtttatttctgtatagctggggctgaatttactctaaataattaatatatttatctaaacaaatgtcagtttaaaaagagctgtcttaaaataatttcctctcctgggtgacttaaaagaggcaatctaggagaaaactacattcttttcttctgtcaaccatgctatggatccttagggacctgggttttcttttagggaatcaaaatcttacacctattaaaggcaaaacatggctgggcatggtggctcacgcccgtaatcccagcactttgggaggccaaggtggaaagattgcttgagctcaggatttcaagaccaccctgggcaacaaagtgagaccctgtctctacaaaaaacccaaaatattagctgagtgtagtggtgcatgcctgtgatcccatctactcaggaggctgaggaaggaggatagcttgagccccgaatgtcgaggctgcagtgagctataattttgccaccgcactccagcctatgggaacagagcaagaccctgtatcaaattacaaaaaaaaaaaaaaaaggcaaaacatacctttaaaataaaggggggaaaatctacctataatctactttaagtcttctgtgaagtagtattgcacactgatagctaagattgagatttcactgtggagggcaatagaaaaaagcaggtaacaattttttttcacattcacggtctgtttctaacatatacatgccttcttttgagggatctttgtcttaatgttagcaactactacagtttgtgtccctgcaggtgcccaagaaatgttgagtgaattaaatttcattttgaacccagagatactaattaaactgattttaagtgatgttttaaagatgaaaaagggccaatgactatatatttctccacaaacgatgaataaaatagttttcagaaagtttggagtgtgtgcttaaaactatatttggggggtggcctgatttttaaaatttcctgtaaccacattttggattatttcaaggtccaatgtgatacaaaagttggagaaattgaaaataaattttataaaaattataatgaagaaatatacagcatagaagaataaaagggaaacaataaagggttaaaagtacagattccagagctgtccagttcagcagccactagccacatgtggctattgagcatttgaaatatggctagcatggactgagatgcattgtgagtataaagtacacaatggatttaacatgatttagtataaagaaaagtctgtgaaatctctctctttctgttttccccccatcagaactctacttttgcattcagacaggcaggggatgcctcatcctttgaatactggcacattaagagcagtgacataggtaagaactgaacccaagcactataagagaggatgttaagcaagatctaaaaatcaacgtgatcaacaagagcagtaatcttttcttttccaagaaaaaagaatggaagaaacagaaggtactgggcgcaatgtattaaacactgtgttttgaatgactcgagattctacgactgcctggaggggttttgctggatcggtgcaatgtcatgtgattattggaaattaatcccttttttcaagaatttttcaagaattaggttaagttagatttgagcaaacttaattaccttgccaggcatttgtttttcagaaacataataatctatgtatttgattcaattagtagtaggcccatgggttgttctgtaaatcacaagtatgaaatacagactctaaaattcatttattgagcaattaccatcttctgggcaatgaccttgtgagaggaataccattatgcctattttactaatatgagaaataaaccaaaaagaggttaagtaacctgtccaaagaaatacaccaagaagtgggggagctgatttgtacccacaaatggttcttcattaattctctttcagctgggaaagataatttcaaatgttagcatatgtcctgattttatcttgtgtacatcatattaaaacccagaaggactggttggccaatcgacatcatccttcaaacttttctccctctctcccttcactcaatctagtcaacaattagaagacagaatcgaagtgtgatttgttgatacccaaaaaagactatgatgactgaaggaaatgtagagtactctagatcacaaaaaataattcctgcatggtgatggtgagggttcagttctcgttctccccatcacaattctatgtatatatgccatgaggacaaacacttgcaaatataggcaaactgctgattgtgggagggtggggcagagtgcagaatgaatcagctattaagataaatcatctattcaactgttaaccccaggcaagcacaaaacccacagaatattatgaaagaatattctcaagcactaggtgtttttaggaattctagaaacaaagactgagatagcacttgttacagactattttttttagagcagttttaggttcacagcaaaactgaaaggtacatagatggctgggggcagtggctcacacctgtaatcccagcactttgggaggtagaggcgggcacatcacttgaggccaggagttcgagaccagcttggccaacatggcaaaactccctctctactaaaaacacaaaaattcggcgggcgatagtggcatgtgcctgtaatcccagctactcgggaggctgaggcaggagaattgcttgaacccagggagggggaggttacagtgagccgagatcgcaccactgcaccccagcctggatgatacagagatttcccatatacccactaccccattcaggaacagcctcccctactaccaacatcccccattggagtggtacgtttgttacaatcaatgaacttgtactgacatatcattatcacccaaatattattaaacaatctctccttttcttactttttttgtggttattagaaaatttaaaattacacatatgtggcttgcattatatttatcctggacaatgttgctctagaatcaacctgcctgggtgttaaatcctccacaaacctgaggtatgaccttaaacagttaacataaccatgtctcagtttccttatctgcacaatgggcttaaagacaatactttaaagcagcggtccccaacctttttggcaccagggatcacatttcttggaagacaatttttcctcggaacaggagtgggggtgggtagatggtttcgggatgaaattgttccatctcagattctcattaaggagtgcccaacgtagatccctcgcatgcgcagttcacaatagggttcctgttcccgctcctatgagaatctaatgccaccactgatctgagatgggacagagctctgttggtaatgctcctgcgccatgctcacctcctgctgtgcagcccacttcccttctgtggcccagtggttggggacccctgctttaaaggattaagagcatttcttagacatactgatgttggcatgtgccaatgttcagtaataatagcaagggtaccagcaaaatgatcaaagagtgagcctattccgagacagaacagaactggaagtgggatatagttgaaaaatggaaggatcactagagcagtttattaaaacacacacaaacaaaaacaatacaaagcaagcagatagctagttagtgtttaaagttacattttccagggtcataaaagcatcattcctatatcagttgttacagaggaaatctggaggaaatagtggcagattgcaggtatgctgaccattgactgaaaataaaaataaatacatctacaaagcaaggacaatgatacatctgtggttgttaactggagtcttaggctttcatcccccagctttgctgaggatgcagaaactgagttaagccaacatcagaggcagagcaccgagcaacaaaatctgactttaaacagattgttgccagtgattttctcaaaccataagtaaaacacagaatctatagtttgcccattttttgttttgaggcaaaaagttttaattttatacccataaggttgtgagaattaaataaaatatcacatctattatatttacatgcattaataatagcttattgggaatattattatgggaaagtcatgaggataaaaaagttatagtttagtttcaccatgtttaaaatcataataatacggctgggcgtggtggctcatgcttgtaatcccagaactttgggaaggccaaggcgggtggatcacgaggtcaggagatcgagaccagcctggccaacatgatgaaactccgtctgtactaaaaatacaaaaaaattagctgggcatggtggtgcgcacctgtagtcccagctactcgggaagctgaggcaggagaatctcttgaacctaggaggcaaaggttgcagtgacccaagattgtgccactgcactcccgcctggcaacagagtaagactccatctcaaaataaaaataaaaaaaataataataataattgtgaattacatcaaaattggaattattaaaatacaatcagattcagacattaattttttcttagagtcagggtcccattctgtcacccaggctggagtgaagtggcatgctcatggctcactgcagccttgaactcctgggctcaagtgattctcacatctcagtctcctgagtagctgggactacaggcatgtgccatcactcctgactaagtttttctatttttagtagagacagggtctcactttgttggccaggctggtctcaaactcctggcctgaagtgatccttctgtcttagcctcccaaagtgctgggattccaggagtaagccaccacacccaacctcagaaagagtaattttaagaaaaaaattaatgtagaaatcactgttgatttaaaatatggagcatttcaagattggagagtcataaactaatttggaactatttaatactttttacatttgctagtagcagtgacagcagaaaatacatttccaagtggtagaatttaaaattaatgtaaatccaaagagctaagatatgaatggagaggaagaaaatgagtgattttcttatggataaaatgtgactatcattaaaaaatagagtgggtgaatgaataataaattaactagaatattgagataaggaaaagtaatattgagacttcttaggaaagtaattaacactgttaactgtcagtgtagaataacttcaggagtggctaataggcctacagagagggtctcatccctgagaaccctccccagtacacagggacaagctcaggcagaacctgatcccttaggcagaactgattggttcagagaaggacatgtggcctaagtgaggccaataagattctatctcaggattttggaatttggagctgagcaatacagaaactaggagtcagagtcatatgaatggcagtgttcttgagagaaggtctatggatctagaatttattgttgaggatcttggactcaccttgactcctggttcaacgacaggcataactgtgtctggtactgtgctctttctaatactgctctcctgcttcctctcctcaactccctttaggctcaagctagcatgtttaagtttctgttatttaaaaccataaataatatttcaaaacaagtcacttgaggtaatatttatacagtagcaagaaaaaaattactactttgatgttttcaataaaattctacatactaaatgtaaattttctataaaatttatttaagtatgaatgatgaagctctgaaaattccaggagagatatatgcagatatcagggaagtaataatagctgtcaataaagaggaagaacatgaattttccatttggttttacggattacgtgatgcttatgtttctcattttgcaaacggaagattgatggaaactgtcaaaatctagcccaggcccataggctgttgtctgagaactattaaaccatagaggctctgaaacacagaacgtatttatctttttgtcttttggctattcaataaactcatttttacaaatggaattgaggtcaggggaaattgattgcctcaaggtcaggagggcaattttaggcaaggctgcttctagaaccctgtctaatgctctttggaaataaacacattgttaaagaaatgtctcctgaagattggaagcataatgaataaaacaaggtagcctagtcattacagatagcttattggtaatcaaagcttgccttgttgtgttgtaaatgtttagattgtaactgtctaaacatttcattgatattttttgaagcatgggagatattaatttattcacttatgagtcactgtggatgtaaaaaaacaaataaatgaaattacttcataatgttaaatactacaacataacaatttgatgttcttttttaagatttcatagtgaatgtgattaggcagcaatatattatgctaaaattttcatctcagaaatagtttcattagcctagaatttgtgggttgggacattgtaattattattccataagtaagaagatactatctctaatgcacaagactttggatataaaagagaagcacacattttattgttcctattaaaactgtgcatgggacatctatggaaggtctgttccaccctttgactgtgggaaaatttctactctatattcttctctataaatgataatgaaattaaatgaatgtagatattctgccaccctgcaatctttactaactttgaagttttcattttgtttactaaataaagaaaactaatatattaaccacctgtgtcaaagaaaagtagaatcagttttttataatgagtacatattattattattattattttgtatttttgagacggagtttcgctcttgttgcccaggctgtagtgcaatggcacaatcttggctcactgcaacctctccctcctgggttcaagctattctcctgcctcagcctcctgagtagctgggattacaggtgcctgccaccacgcccagctaattttttgtattttttgtagagatggggttcaccatgttggccaggctggtttcaaattcctgacctcaggtgatccacccaactcagactcccaaactgctgggattacaggcgtcagccacagcgcccagccgagtacatgttatttttataaatgagagaaaatgcattttactgttagaataagtggaatcaagtcatgataatgtttttcactcctgttggtaacttttcagccctatatttaggttaagcttgctatatcatatttattcatttattttgttttgttttgtttgctgtgtcatatatagatatgttttgttttcaaaacgaaaacaaaaaaatgcctttttttctcattgtaaaagtaatacagagatttccagttccaagacagttccagttgcacgtctccctattcttctgctaagtatagctaaaaatcctggacagtatatgtaaaataaatataaggggactctggaaggtagaaataaggcagattggctatttaccttaaaaaacatgctagcaaattccttgggatttctttttgtttcatatatcccagactacgtactggcaatacaggcaacctagaaatgccagggggttcatgtaacactcccccatccctaccccaagcctgctgtctctagacaaaggaccaggaaaggaacagcctggtaaggcagaaaacatttagttaataaccacatatgcagaaaagttaccatgggaggcctaagcctgccatccttagaaattcttgcttgcaagattggtctttggctggcatctgggaacatcctacagttcctatacagatatgaaactttccccaaatgataagaatggctcactgagactagactgttggcaaacaatgtagcttctgctgcacagctgctttccttctgagagtctgcagttttgataggtgcaagacagtgggtatctacatgatgacatagtttgtctgtgtccccatccaaatcttatcttgaattgtaattcccataattcccacatgtcaagggagggtcctggtaggaggtgattggatcatcggagtggtttcccccatgctgctctcatgattgtgagtgagttctcatgagatctgatgattttctaagtgtctgaatttcccctgcttgcacatactctcctgctgccatgtgaagaaagtctttgcttcccctttaccttctgccatgattgtaagtttcctgaggccaacccagacatgtggaactgtgagtcaattacacctctttcctttataaactacccagtcttgggcagttctttatagcagcagtgaaagggactaatacaataatcaactgtccccaaaacctagggcactgattctctaataatcttcctttgtagacacaattcatgcctgttgtcacagttccctgttaacaaaattaagtgtgctctgtataatttcccttggagagaatccttagaatcttgggcctggtttcctccagacttcattccacgaggctattccttttgctcattttatttgtgacaggaactatacgctgagtcctgtgagtcctcctaatgaaacgctgaacctgggagtgttcttggagacctctgacacactgccatactccaaccaaatatcacagaaaaaggagtgttcccacccccaccgatcagtagtagctgactgggaagcctagactttcacccttgatggactatagggtcctctaaacccccaccaggctggtttcagagaaggctgagtgggaagcccaactttcaccatcttccagtggtaatgagtcccccacacaccctccaaagtgtcattggaggccacgtgaggatatgacagtgaaacagcaaaagaactaacataactaatccattttttaaggggcctttactcattcctgcatgtaggctaggataattttagaacactgagataatatgcaaaaacagcaatcatgtagttttaaaaatgaactctaggattaaaggagaagtatgtaaacagctaactatattttgttaaagatttataggaacattttcacatgacaaagaagttcccaaccactgtggaccctcactggtgccgagatgtctgtggttattggtcatctcttgatctcaactccctccttgtccccttacccttacacaaaaagagcctaaaatttgtcttgacttaagatggtactttagaatgatggtccaccatcttctcagttagctggctatctgaataaatctgcttttccttccaccaaccatcatttttcatgtctggctttcaagcagtgagcagctgaacctaggttcagttacatggggcagtaatgaggcatccctctccctcccaaccagggtggtatcagtggaggcctagtggggagcctgaactcccaaccctgctcagcagtaatgagataccttccccaccaacctaggttgtcaagggaggcctgatggagagctttgactctctccctagtcagagaggttggaggtggcatctcccttctcctaacaattcagtgtcagaggaagcctgctgaaacagaaaatttaaataagattcagcaccaagataatacagatgttggaatgacgttatcctagcctacatgaagggttttaaagcagtcatcataaaaatgcttcaatgaacaactaagaacatgctcaaaatgaataaaaagtgttagcaaaggaatagaaggtataaagaaaaatagatggagattttagaactgaaaaatacaatatcccaaaaaaaatcaatggatggaagaatggaggggacagaagaaagaatgagcctgaagatagaacaagagaagttatctaatctgaacaatggagaaaaaaatggactgaaaaaaaatgaactgaggttcagggacctgtagactataccaaaatatctaacatttgcactgtcagagccctggaaggagaggagaaagagggtagacctcaaaaagtgtttaaagaattcatgtttgaaaattgcccaaatttggctaaagacataagcttacaggttaaagaagctgagtgaaccccaaacaagataaacacaaataaatccccatcatgacacatcattagtcaaacttttgaaaactaaagacaaaagataaaaatattgaaagcagcaaaagggaaacaatggcttatgagtagagtagaaaacaattagaaagtcacaggatttctcatctaagacattggaggctagaagaaagaagcacatttttcaagtgccaaaagaaaagaacagccagcccagaattctgtatgcagtgaaaatatgcgtcaggaataaagcggaaatcaagacattctcaaatgaaggaagactaagagcttttgttgctagcagacctactgtgatggttaattttagatgtcaatctgacttgattaaggaatacctagaaacctggtaaagcattatttttgggtgtgtctgtgaagatgcttccagcaaagattagtgtgtgggtctgagtggactagctgggggagatccacccgcaatgtgggcaggcaccatccaatctgctaggggttcagaaagaacaaaaacagagaaaaggtgaatgtgtcactctatctgccagaactgggatgcactttttcctttcttgtcctaggaaaacaactccaggctccccagcctttgaactctaggacttacacaaaagtcaccctccctccccaaccaactgggttctcagacctttgtccttggactcggagttacatcactgacttccctggttctgcagccttggagcttagaccccgccacactaccagcatcccagagcctccagtttgcagacgacctgtcaagagatttctcagcctccacaattgtgtgagccaatccctctaataaatccccttacgcttcacttgaactactaacatgttatcgctaattgactgttttaagttatgtaaatataatgtaatacctagagcaaccactacaaaatttacagagataaactaaaaaaaattatacaaagagatacactcaaaaaccttgcagacaaatcaaaatagaattctaaaataatattcaagaaatcaatagaaaaacaagaaaaaaatagaaaaactaaaaatagaagcaacaaacagaaaacaaaatatgggttggaagacttaagtctcaacagattacgaattaccttataaacaaacagtctactttatttctaaaaggcaaaactcagaaacaactaaaatgcccagtaagtgaatggctagacaaattgttgtacatccacacagggaatcctactcagccataaaaagaaatgaactattgatacacaaaatagcttgactggatcccaagggccttatgatgaatgaagaggctgatttcaaaacacttatactgtatgattccatttacataacattctggaaatgacacaattatagaggtggaaaacagattagtggccagtgattaggagtggtccgaggaatgtggatggatgtgagtacaaagaggtaacacaagtgctatgtttgtggtgatggaatagttctttgtgttgatcatagtggtaattacatgaatccgcatgtgataaaatggcatagagctatatgtacactcattgcatcaatgtcaatttcctggttttgatgtactatagttatataagatgtaattcactggggaaaactgagtgaagggtacaaatgactttttgcagaagtttataataattaaaaattataattataaagtaatgtatttataattataaatataagtatcattataattataaaatatttataattatttttaaataatggtatttttaaataattgtagattttaaataattgtaggtttagataattgtagattcccaggagaatctacaattatctaaaaatagagtttaaaaagtctcataaaagtctcataaaaggcatggtggcttacacctgtaattcccagcactttgagaggccaagatgggtgaattgtttgagttcaagagttcgagaccagcgtgggcaacatggcaaaactctgccctagaaaacacacacacacacaaaattagctggatatgttggcgcgtacctgtagtttaagctactcgaaatgctgatgtggatcacctgagcccagcacgtcaaggctgcagtgagccatgatggtgcagttgcactccagcctgagtaacggagcaagataaaaaaaaaataacataaactatacatatgtgtgtatgtgtgtgtataaagtctagaaaagcaatgataggcactacaaaaagttagcagagttatgaacgtatctgtgttatttcaatattttttaaaagaatgcctttatgaacttctcatataaaaaagaaataaaagtaatgtaaaactgtaaaaaattcagatgtacataaaaatataaacaagatggaaattgcctgttctgtgatgccacagataatttcattaattcacctaacaaatatttactgaatacatcctatagagctatgatctatcacgattttagtgtgcatttcagacctttcctgtacctccagagttatatacaaattgtaatcattcattgatatgtattgttacaagcgtaatatgtacagctggccctctggatccacaggttccaaaactacggattcaaccaacctcgggtttgaagtattaggggaaaaacccaaagataataagacaacaataaaaaataatggaagtaaaagcaatacagtataccaactatttacataggatttccattgtattagatattataagtaattgagagatgatttaaagtgtatgacaggatgtgtataggttatatgcaaatactatgctattttatatcagggactggagcagccttagattttgttatttattgggggccctagaaccaatcccctaccaataccaaaggacaactgttacatcataagctcttattacttaacattcattattcattcattcagcatatatttattgagcatctatgttagccaatatcatgctaggttctgagaatggaaaggtgaataaattgtctgttccttaacaaaatttactgatatggtttgtctttgtgtccccacccaaatctcatctcaaattataatccccacgtgttgagggaggggcttgctgggaggtgattggatcatgggggtggtttcctccatgctgttctcatgataatgaggagctctcacgagatctgatggtttaaaaggggcaggttcccctgcgtgcacgctctctctctctcctgctgccatgtaagacatgccttgcttcctcttcaccttcttccatgattgtaagtttcctgaggcctccctagccctgtggaactgtgagtcaattaaacctcttttatttagaaattacccagtctcaggtagcatctttatagcagtgtgaaaactaatatgcttacaatatagtgggagagaatgtcactaaagaaagaatatttccaagaagtatacaattatagattatgtcaagttcagacaactgtaaacaatgttctgaatatccatctgtgaaaggaaagggtgatggctatgatggcaagataccatggcatgtttattattgatgggaatgagccagtagaaagaggttaaaaatacaagagcaagagaagggaatcctggatttatagaaagcttccttagaaggaagaagccggagaacaagttaaagggttggcttcaaatagaagcgaactgcctcaactgaaataagcaagagtgaggatgactgaaaatataccttagtttgtagattcagaggtttgaagaattgccaaaatatgggacaatgtcatctgcctagagcaaaggagtatattggaagttctgaggtttgaagagaatggagtttttaagtagtagtttggggaaagcatgctgaatagagaagggcagtaactgggcatgcttcattaagaacctgtattctgtcatgtggggcagattctaaatattttcagctctcttactgcaggcaagataaaggcaaaggagtaggtattagaagagagagacaaacttctagagggaactaaatttttgaagaggattgtcttccaactgggaagagagggaaagctttttgaggggagtagatctgagctgggcaagagaacacacttgctagagaaagaaaatggccagagagagaaaaggggagaaaaaagtctgggggagatggagataaaagcagagtagtgggggatttctggcctaggtgcaggaatgtccttttatcttccaaagtaaatgtggtcacagtaatattaacagtttgtcatctgatgttgtgaaattgtttccatatattatttagactctcagacctgacaatctatggaggaattcccaggcatctttagctgctacagagatgcatgaatgaaggacaagtatattatcctccacacattagaagagaggctccagggagcaacaggaggcaaaagttcttcttttctttttttttttttttttttttgagatagtcttgctctatcacccaggatggagtgcagtggcatgatcttggctcactacaacctccacctcccaggctcaagtgattctcatgcctcagcctcccgagtagctagggttaaaggcacatgccaccacacctagctaattttttttatttttagtaaagactgggtttcaccatgttggccaggctggtcttgaactcctgacctctagtcatctgcctgtcttggcctcccaaagtgctgggattacaggtgtgagccacactgtgcccggccaacatttatcatttgtgttgagactatcccaacctttctcctctattttgaaatacaaaataaattattgattactatagtcaccctactgtgctgtggaacgctacaacttattccttctgtctaaccatattttcgctccttttaacttctcttcatctccttctccctccttatccttcccagcctctggtaaccacaattttactctctatctccatggagtcaacttttttttagctcccacatatgagcaccaaacttcaatgtaagacccaaaactatgcagctattccaagaaaacgatttgagaaaatgcttgaaaatgttggtctgggcaatgattttttttttttttttaattaagactttctgaagaaaagggcatacttttcactgaaaaagtttgagttttttaaatgagcagatactcatgcattactagtgcagccaaaaattatcaaaagtagggaagaatgcaaaatagcgtgtgcctcttaactaaagaactgttaagatacaaaacttggctctttgctgcctttcccgcactgccaagagggaaacatgaattagttacattgccgtggtgctcactgggagttcgctgtatggaccagatgggtactgctccgaatttccattcaagtctgacattcttttgtcagcgtttgtgtaaccggttttccttgcattcagaggaaagacagcatggaagtatggatgggaaggttgagacgattggatactgtatggtaacctcgatcgcagctctcctatgagacttgcttcttggattctgagtcacttaagcttgccccttctctttcctgaccctcttccgtttccccttagattggagattctcctcagattctaagtctctgaaattattagtgttggcagcccctgggcccatggaggggtctcaagtcttcagttctcaaagatcaccttttaagcttcattcggaacatgacacagccacacgagtcctagccctgaatctcacgaagacctcagtacacctggaaaaggcagcacacccagttacgacactactagagacgtcacacgcctcagcacccatccgctcccagcccagaacgagcgcacgcgcagaacgagagagcggccacccagggatcggcgctatctgcacagcggttacagtctcggaaaggcctggcttcttcgtggctttgtggagatcccttacagcggccatttgattagcacccgaagagattcaaaggaagcagttgttccgtccccaacatatttccgtttcaaaccacccacttccggtttttcagccggttccggtcccgcccttcacttccggtcgctttcggtctctcagcggccggtttctgcgtccgctgccgcaggttccaccgcgctccaggtgaggggttgcggggcaccctggcgcgctgcccttggagacgctgttggggctcggggacagtggctttgcggcccgcgcggcgtggcttgcactgcggcgggctggggatagtgtctgtcctagtctgacgcccaggcccctagccccggcccgcttagtcgcgggggccgctgtcctcccatccagcagtctagcctatttggagggctttctgtttcccagtgggttttgcgtccccaaacttcattcctccgtcttctcaggcttgtccatccctcccctcaacctccttgttgaaggcatcccggcctttttggttctggagcctccacctgcctcctaatgctcccctaagtcagttagcacagcccccgaccctgcaccacctcgcagttgttgctggtgtgcggttctcgccggagttcttagtgcttcacggttatcttttgctgggattgttgaaagttaacctcccgttaattcccaaagtgttacttttactgctatactttaaaatttcttcatttgccactttttaggtttgtggtcccgggcaagtttaatttcttttcaggattctcatttgtataatgaggacaacagctgttggttcaggattgtgaagcttcaatgagataattgtttagcatgtttttattccatcatgaacaccatttgtattgtgttttacagtttacaaagtgctgtcacaggtgttacttcataccttaacactactcctgtccagtgaatattagtagcctcatcttgttgagaagactgaggccaagaggtggattgactaggcaaagtcaacacagtatgttaggtagaactccaacctaaacagctattcttgaccctaggttgaccatatggaagtgtattctttgcttgcttgtttgggtttgccaacttcactcctccccacaccccaaatcatttttcagcttataaatctgatgggatctgaaatgatacaaaatactaagaaagaaggttaaatgtgaaagcaaaatagctcatgcatttatatcacactgcttcattggtgtgaacggtcttaatgatgaaataaggttcagtaacttttaaacaaatcttaaagacatatgcatttacaatttttatggtgtttgtttcgcttggccctttaaggcatttgccaacttggaatttccacttgtgggataggtgcttcgtaacgtttttatgctgctttattaaccatatagagcccatgccctctggcacattttttttaaggctgaaaacattgaagagcctgtagtactgactctcaaatttgagcattcatcagaggtgaggaggactgaccttgttaaaacacagattcctaggtcccttctctccaccccaattacatttctaccaaattaccaagtgaggtcaatgctgttcgttagcccagggaccatgctttgaaaaccactagtctagaagagcaatcacttgtccagggtcacctggaactcagatgatttcactccaaactctgcactactacgcatcacaatatatgcgatattagtgctggttgcctttctagctctcgtaggattcccttttattcttatgtcttacagaaaatatttaaactgtatttcagtttaactcaaaaggtccacttttaattgaagaatataacatttgttatagttctgtctaaaatggaatacgttaccctaaattaagacacttgctttacattttcagtagaacacattgtaaacataggagtaaatatacatttatagttcatatttgtattcatatatgagtaaatataaatatgaatttatggctctctcttctaattggccttttagtaggagacactgtttttaaattatttttggaagtggagattaaaaatttaacctctttcttgcagttggtcctaatagttgcatgaagagtgcaatcaaatgtttcatcaaataagtgaaagcattggaaataccaataccttgagattagaaaatccagttctctggactgtgggaggaatgagtttaatgaaaaatagaaagctttatgcaggaagagacatatgtttggttatttacatgagtggcagccactatataatctttgtgtgcttagatctgtacccatgggttttgtattttctgattgatatggtttggctgtgtccctaccaaaatctcaacttgaattgtatctcccagaattcccacttattgtgggagggacccagtgggaggtaattgaatcatgggggccgatttttcccgtgctattcttgtgaataagtgaataagtctcatgagatctgatggatttatcaggggtttccgcttttctgtcttcctcattctctcttgccactgccatgtaagaagtgctttttaccttctgccatgattctgaggcctccctagccattgtggaactgtaagtagctgggattacaggcgcccaccaccacctctggctaatttttttttgtatttttagtagagatggggtttcaccacattggccaggctggtcttgaactcctgacctaaggtgattcacctgcctcagcctcccaaagttctgggattacaggcatgagccactgtggccagccttgggtatgtcttagcagcatgaaaacagactaatacggtaaattggtactagtagagtggggcattgctgaaaagatacccgaaaacgtggaagcaactttggaactgggtaacaggcagaggttggaacagtttggagggctcagaagaagacaggaaaatgtgggaaagtttggaacttcctagagacttgttgaatggctttgcccaaaattctgatagctatatgaaccataaggtccaggctgaggtggtctcagatggaaatgaggaacttgttgggaactggagtaaaagtgactcttgttatgtattagcaaaggtactggcaacattttgcccctgccctagagatttgtggaactttgaacttcagaaagatgatttagggtatctggcagaagaaatttctaagcagcaaagcactcaagaggtgatttgggtactgttaaaggcactcagttttataagggaagcagagcatagaagtttggaaaattagcagcctgactatgcagtagaaaagaaaaacgcattttctgtggagaaattcaagctggctgcagaaatctgcgtaagtatcaaggagcctaatgttaatcccctagaccgtggggaaaatgtctccaggctatgtcaaagaccttcatggcagcccctcccagcacaggcccggaggcccaggaaggaaaaaaggtttcgtgggcccggcccagggtccccgcgctgtgtgcagcctagggacttggtgccctgtatcccagccactccagccatggctgaaaggggccaacttacagcttgggctgtggcttcagagggtggaagcctcaagccttggtagcttccatatggtgttgagcctgtgggtacacagaagtcaagaattgaggtttgggaacctgtgcctagatttcagaagatatatggaaactcttggacgccctggcaaaagtttgctgcaggggtggggccctcatggggaacttctgctaggacagtgtggaagggaattgtggggtcagagcccccatacagagtccctactggggcactgcctagtggagctgagagaagagggccaccaccctccaggccccagaatggcagatctgacaacagcttgtactgtgtgcctggaaaatccacagacactcaatgccagcccgtgaaagcagctgggagggagggtttaccttgcaaagccacaggggtggagctatccaagaccataggaacccacctcttgcatcagtgtgacctggatgtgagatctggagtcaaaggagatcatttcggagctttaacatttgactgccccgctggatttcggacttgcatgggccctgtaacccctttgttttggccaatttctcccatttggaatggctatatttactcaatacctgtacccccattatacctaggaagtaaatagctttcttttgattttacaggctcataggcagaaaggacttaacttgtcttagatgagactttggactgtggacttttgagttaatgctgaaatgaattaagactttgggggactgttgggaaggcatgattggttttgaaatgtgaggacatgagatttggaggggccaggggcagaatggtacagtttgactgtgtgcccaccaaaatctcaacttgaatgatatctcccataattcctatgtgttatgagagggacccaggggaaggtaattgaatcttggggggtggtctttcccatgctattctcatgacaatgaataagtctcatgagatctgatgggtttatcaggggtttccgcttttgcttcttcctcattctgtcttgccactgccatgtaagaagtgctttttgccttccaccatgattctgaggcctccccagccattctgcaactgtaaagtccaattaaacctctttctcttcccagtcttgggtatgtctttattggcagtgtgaaaacagactaatacactgatctttgatgccttaactcttgtatgttcaactgaagagatacaattgtggaggagaagaaacataagatttagtcagaagacctgttctgtaactagctatgtgtctatgtacagattgtatagcctctcaaaactcctgtttccttaattgtaaaagagggaaaacttaccaaattactttctctaatgagattgtgtaaaaacttcaattcataaaatatgaaacaaagaatggctatttactatttatttagcacagtgcctgcctggaacatagtaagcttttagtttaaaaagatttttgtttaaccaatacttaatttatgtagtgtttactaggtgccaggcactatgtaccttgtaaatgttaattaagttaatcctcataaaagccctaagaagtaggtagtatcatcatccctattttacagatgaggaaacctagacactgagagtcaagtaacttctcaaagtcagatggctaagtgggagagatctgggatctgaacccaggtcatctggctctagaatctgtgttcttaactacaccacactacctttcaaatgttaaatgaacatggatggtctgtcagggaaggacttgcttgtagcatcaacctgaccaaatagaacaggaggaatggtagctcataattgcacatttccagttgaacagtgagactcagagtattagaaagtagtaactctaagccaaaaattaggagtgtgggggaatttaactttgagtcctagtatcttttggtgttctggtagcactcctgtatggacaaaaatcctctctatcataagttgtaaaataaggcttaaactgtacacataaaacttaaaagtttggcttcaataaacagtatctattttaacttgttcatttttgtcttcctttccaggtatttttttttctgaaggaaagctgcttcctcatatgtttcaagaatggctctccctatcattgtaaaatggggtggacaggagtattcagtgaccacactttcagaagatgatactgtgctcgatctcaaacagtttctcaagacccttacaggagttcttccagaacgccaaaagttacttggactcaaagttaaaggtaattctctcccctcttcagattttttgcattgaatttttagtattatgaattttaataattattttgaatataattgtttaataatttatacttgctatttgtagtttagtaagtctctccctttcgagatttctctggtagaaatattcttaaaattgttttagtggtaaaagtaagaatattaaagtgttctcgaaaataccatgattattaagattacttttgatgttttagacagtcagtatttgcttgttaaacctttggcacagaagtcccggatgaaactcatttattttctgacatctaccttttagcacagtgtttcgttgtaacgagggcctcgtactcttcccaaattatcttttctgtttcaaaagtaaagacaacatttaaaaattacaggcagcattcatatccagtttaaaagggattttttttatggtgttttgtgattatcatattgaagagtgagttttgagtaacagtaaatctgcagttttcttaggcactcaatttttaaggcttcctggaaaacagtaatattcatcttgaacaacagaataaaacatgaattaattttgtttaggtagttgaataaaggtgttcatctaacatagaattggggagaaaataacccttgtattaattttgacttcttcgtgtcttagatatgactaattcagcagaaacaatttgttaatgtaggaaaaaacaaaacaacaaaaattgctgtgacatctgtaccaaaccttttaatgttagggttttatataatggaatagtgaaaccagcacctgaactttagtgagaaaacagtcatttgcttgtattgtaggcaaacctgcagaaaatgatgttaagcttggagctctcaaactgaaaccaaatactaaaatcatgatgatgggaactcgtgaggagagcttggtaaatgtttactttttgttaccatttgtccatttgaagatattatgatttatactacactgttgtattatagttttaattgtggtaaaattgtcagtctagcaatcaatgaaaaataaaacccgcaccgtgaatgtgttattaactgtataagtatagtagtagcacaaatgatcaaatttaatatggtaaatctgcccaggaaacatacataacgaattattaattgtggaaattttccagtatgggcttaaaagactctggaactcaaattgtatctctcattttatttttatgctatgcatgtatttgttatattaaggataatatggtagaacaaaactttttccatcttaataggaagatgtcttaggtccaccccctgacaatgatgatgttgttaatgactttgatattgaagatgaagtagttgaagtagaaaataggtaagtgcttttcgctttagaagtaatcagttgtcatgtgagaacaagtgaatattttatctaattatatgttttccattagggaagaaaacctactgaaaatttctcgcagagtgaaagagtacaaagtggaaattttgaatcctcccagggaagggaaaaagcttttggtgctagatgttgattatacattatttggtaagtcagttaagaatgcttttcattttctgttacccacaacaactctttttttcttttctttgttttttttttttcttagcaactcatggttctcgtgaaatacttgaaaacttttcttattacaaaagtaaattgctcattgtaaaaaatacagataagcaaaaaaaaaagtcatctgtaatcctgatacccaaagatgaccactcttagtaatttgatatatatcttttagactgtttgtatggatctcctctaaatcttttatttaataacacattgaacatcttctcagtaaaatattgtttattatgaatgatatatatatatgtgtgtgtgtgtatatatatttttttatttttttggccagaaagtattctagtttatggatgcatcatcatttaaccatgttattccctgttgattataaataattttttataaggaatattttaaaaattatgtttgatattttatcactagttttctgtttagttatattcaagcagattcttgaatttaaaatttctcatgtaggccaggtgcagtggctcacatatgtatcctggcactttggaaggctgaggtgggaggattgcttgagctcaggagttggaaatcaacctgggcaacagagcaagacctcatctctaataaaaactaaaaatactcgctggatgtggtggtatgcacctagtcccagctactttaggaggctgaggtgggaggatcacttgagcccggattaagactgcagtgagctatggagtgccactgcactccaacctgggtgacagagtaagaccctgtctcaaaaaaaaagaaagaaaaaaatgttttgtgttcattgaaaaagaaagatgttccttttatgtctaatgttggcaagaaatagttaacttctgatactggaatttatttctaaccctaaacctaaaacataagttaatgtacagtttttaaaaatttaattaattggttaattggcctgtcattttgatgaaatgtgattatatctgcaaggtagatgactaaaggtgagtataagtggacatagtttgtttttcattattaaaaaataacatctaaactttagagactaggtgagaaaaaaattttcagtttactacttaagcctgaattttcagtattgctttttgcaaattgaacaaaattgatcgactaaaattggatcttaaggattttaaattgtgttttgaaagacatctttttgtcagccaacgtaattcagtctgaagcagtttgcaatgaaatgtttatgtttgcatttcgtaatatattacatttaataataattggtattaggtacttgttcatgatggtaaactaataattatttatgatcaattttcttttagaccacaggtcttgtgcagagactggggtagaattaatgcggccatatcttcatgaatttctaacatctgcctatgaagattatgacattgttatttggtgtaagctgtatttttttgtttagatttccgtggaaataggttgttccatatattattgtgctgtataaaatgtgacttaaaatgacctgtgtttaaatatgaaatagttttcattttttagcaaatttctaaaatgaagcatgtatcacaatataaacttaaacatatattggccaaataccagtgagatagttaatttaactataggacatgagtacattatagtgtaagaataaaaatgactaattttcccaatgaccccaccttgatttgaagtttttccttctgattttttttttttttaactaggcacatatctttagggtctcgctgtgttgcccagactggttttgaactcctgggctcaagtgatcctcctgccttggcctcccaaagtgctggattacaggcataagccaatgtgcccagcctttccttctgatctttgctgtgaaattcttgatgcttcagaatatttttcttttctccttttttcctgactccagttttaaaatacttggaaaaaggtgtttaaaacaaaatcacagtgatatagttctctggaaataaaggcaacttgaattacttaaggaaaaattaatatgtggactaaagccagtgacattgaaattgtggtctgcggaccatttcaagaatgtacaggtctgtgataagatactgagtttgttccaagaagtaaatatactgtaatcgtaagcacactattcagttcaattaacgttttttggtagcaagattttcttggaaaatgaagcaatgcattgatttacatccctcctccccacaaatatttaaagttgcctcttggcaatgtcataagcagagaagagttatcctgactgaattaaatgaagtcccatcaagtaaaggtgctacatttcattgtactaggtctttgagagaaattatgttagttgttgcagtctgtaaattcattttgtatttttccttataatcagagtacttccgttgtttgtgatatgtgagttccatgtgagttcacagctgttaagattaaaattattgtcaaaatatataattttctggtttagtaagataaggtgaagaaagcttgctggtttgtttagcaactttgacatctaagatgatatttgagaaaaaagtttatcctttaaatgttattaaactagacttataaaatttgagaaccttttacaatagtatatttaaattatttttataaactgtgatattttgtggtagttcattgaaaagagtacttcactttggagctaaatagactaggattttaattctggctctgttcttactgtgtgacactggacaggtcacttaatctttctgagccttagttccctcacttgagaaatgaagatatctaaatacatattacaggttagttgtaagaatagaagtatcaatatagcaactagtactatgtctgacatatagttacttaataattagaaactttttattagctgtgggtctttttgtttttcgtctgataattacagatacaaagtaagtaccggattaaaatttttttctatcttatgattattttcattggagatacaatagtctttaaaattttagctcaactgaccagttttgtacgtgtaaggtgattcttctgtttttttgtatgtgtgcatgctgaagattttttattttgagaactcaggttcctcttttgcttttaaaaatcacacacacacacacacacacacacacacacacacttcaaataattaaattgctttttctctttttaaacattttacttggttatacctgtatagtttagtccagtaaaccaggagagcacataaagatgaggatttaattttagtattaatgatctcaaagctggttaatgtctgacaatgagcagatacatgatgcaggtatacttcatgaatttgtctcatttcttgttagaagctgctagactcagtgagctttaatttgctgagactgacaaaatgcagattttcactgaacctgactagctggttttcaacataaacttttgacacataacaatatgcttatattgacactatgtatacctgtgcattgcctagaagtaggaacatggaaaaaagtgatccaggcacccaagtttaagtttggaattgatagagtgtcagggctgatttaaaaagagagtttaggtcttgatttataaatttcctaggttcagagttcttttgagcatggattacctgtatcttacagataaaagttgtttaaaatttattctgtcttgaagacacactgcagtaagtttacttttatcaatatttaaaagaaaattaccataagtatgctagggactgttaattctgatgcatttaaacttttagttttgcttagaaaacttacttatacagattttttttaaagaaattcaagcttttcatatgtattgtattatcattcctcgtgttttagctgcaacaaatatgaagtggattgaagctaaaatgaaagtaagtgttagaaagcaatccatttaaaaatattttcaaactgcatttgtcttgttaaaagttctagaactgaattaattttattcttactggagggcacttagtagatagataaatgccattattgggagtagaggtgtttttaaagtgtgtttaataagtggattgtactgaatccctaagtcttttttaagaaaaagtataactaagcttgtcccctcccccacattcttcctcattttacaataatactttattttccttcttttgctctagtgtgcaatacttaaagagtcagtattctcctaaaatggtaaattaggaagtaatctatttctattttccttggtttaccatttattgacttggctaagtgaaactaaaatacttcctagttgtttagcaagatgtagtggccagtggtgtagaaagttggcattatgagaaattgcagctagaatattcagaaaatctgaaattttccacactactatgttttaacctcacaaatatttgtgtttataggagctgggagtgagcacaaatgcaaattataagattactttcatgttggatagtgctgctatgataacagtacatactccaaggagaggattaatagacgtaagaagtcattttatttctatttaatgacaccatggttattttccagtgtactttttatgtttatacctatggagtaaatagtgtagagattcatctgagtgaataataaagtggttgagttttgacataggaaaatgtatttaaggttaaaagatttttttttttttttttttttttttttgagatggagtctcattgtgccgcccaggctggagtgcagtggtgcaatctcgctcacgcaagctccgcctcccaggttcacgccattctcctgcctcagcctcctgagtagctgggactacaggcacccgccaccacgcccggctaattttttcgtattttcagtagagacggagtttcactgttgttagccaggatggtctcgatctcctgacctcgtgatccgcctgcctcggcctcccaaagtgctgggattatgggcgtgagccactgtgcccagccaaggttaaaagatttgaattttaatgataaaattagggatcttgaagtaggactgtcaagaaaggaacttgtgattgtgggtaattgacctgtgttgatgacagcacaatgttactgggcagagtaggtgagaaaaatactgaatattatcaaggaagatactagaaacaagcgaaaacactcaccctgccctgtttgaaactggtaataaaagcagatgcatcatgatgcatgtactttgggatgatgctgaagaatagcaacaagaacaatcagagaaaagggtttggctaaccagttattttactcatcaagtaactactcatactattaagtatctactgtctggaaggccctgtgataggcactgttgggaataaagagatgagtgagacacagtccatatcatttgaaagcacccaaactgttagctgggctggataatgcatgcctgtaatcccagctactcaggaggctgaggcaggagaattgctcaaacccagggggcggtggttgcagtgagctaagattgagccactgcactccagcctgggtgacagagcaagattctgtctcaacaaaataaagtaaaataaaagcacccaaactaataggaattgaggagaacttaggatacgaggaaaccttaggggagacagtattaaaattatcaaaaccataaatagaatgatttaagggcatggggacttgttctataaaggaaatactgcatgtatcgagaaaaagataacttactatatactaaagtaaaataatacatttacaaaatcttaacattaaaaattacttagggaaatgttaaacatgttttataacagtgaaaaattaaaggaataaaaataatcctcaatatccagcaatagggcattggatatataaattactgctacccatataagggactgtagctcgtcatttgatgtagtaggatatgtaatgatttagaaattttcatgacacatttaagtgaaagaagtattttagagaacactgttgtaagccgttagaaaatagttcttaacctttgtttggttcaggattacccttaatttaacaaagaacctgtcaactctctgaggctgctcttgtttataaaaatgcctggagtcaatgtatcagaatattgagttgttgcccttggtactgactagattattgatttaaaattttcctttatgcttttcagtattttcatgttttttttctgtagttagcaatattacttttctaattgagagcaaagtagtttgtgttttggggaacataggtgcttgacctaattaacaaatgacagcactttttaagaggatgtaggatttttattctggatgtcataaaaaatgacctctgttgtcatatttcttgaggcttttgttagctaaaaatccacaaaatatggcttattgtattaattcttatatatttgtcttcatttcgtggggggagtagggggcggtttctatttcggtagtaaacaagatcagtagcaaaaaaaaatcaggaaagtaaaattttagtaaattaaaatatttcattaacattttttgtaataggcaagacaataggaaggaaaaagctttctccaaattaaattataggaggaaaaaaatttttaagttacaacttttatcactatttatttcttaccacttaatctcatatatttattattacattctgttctcataataccgtaagacttctgtcttcagcaaaagtaattttctagaaatttaaaaaattttctgaatgtgtaatacatttgcatgactaaaaaaatagtaaagtacataatgaaaagtcatctttcacctggtacctagccacaatcagtgttatttcctgtgtggtcttacagagactttacacaaataccaacaggtaagactatataagaaattatttatttgaagcttcagtttaagaattcagaaataagagtaagaatttgtaaaatatggtgcttccgaagttaagcaatcaaattccctagaaattatgcacctgtgccactgagttaaagacaaaacgagtttttcctctataaaatattcaaattattaattgaaaaagccaaatacagtttttttttgactagggtgttctagttttgaaagcagactccatgtgactcccaagctctgagaaggaatgtgttaaccaaggaagtcatgtgactgcatagcagacatctaaacaattactttggatttttaaaaaattaaataatttatttattttacccaaaatcttcacgttaaaattatggaaagttttataatgggtttagttcagttggacatgaacaaacctttcagaagttttaatattgcaaaatgcattgtgctttaaagtgggttgcatttaatgattagctcacacctgtcttacagggggaaaggaacactttggcattgttctgcagggcagtttgcagtattcctgcttttaagacaggatgaaatattgataaaatttgagttaaatgtaaacttttattctaaggtaaagcctcttggtgttatatggggaaagttttcggagttttacagcaagaaaaacaccattatgtttgatgacatagggagaaattttctaatgaacccacagaatggactaaaggtaagacatacttttacttgttatgtgctcatgtaatctgggctgtgtggtagaacttttgtagtaagcactgttgaatttcatatatttttggaagtactgtattcttatgtcataggcgagaaaagtttaagaataattcatatagaaattgaactttgtcttttttgcattgatgtctccatagttagctagttcatccaagtatttgtttgtttatttatttatttatttttgagacgggatctcactctgtcgcccaggctagagtgtggtggtgcgatctcggctcgctgcaatctccacctcctgggttcaagtgattctcctgcctcagcctcctgagtagctaggattacaggcacgcaccaccacacccagctaatttttgtatttttagtagagacagggtttcaccatgttgaccaggctgatctcaggctcctgtcctcgtgatctgcccacctcgacctcccacaagtgctgggattacaggcatgagccactgcgcccggcccaagtgttttatttttaattagctctgtgggagcaacatgggcttcccaacattgacttttagcatccaaagtgaaatcattagttatttttttaggtatacaaatcttggcattttaaacattctggttagcttgagaaatggcagtaagggtactttgttttttctttttaaactgaaactaaagacgtttttgaaaattcctagacggcaagtacagatcttagaattagacattgccagagctagaaggaaccacagtcatctcttgcctaccttcttaactttggaaacagtctgaggttgaagaagttcctgacttgcccaagattgtatatgtaactggctaatgacagaatttgggttagactctagtgacttggttcctaggtcagtgacaatcttagcatgcaactgcatgcagtcttatgtgacatttcatcctggtaacagtataaaattggtaagagtgaaatttgaaatttaaaagtttctggtacccatagttgattacatgttggcgcaatatgaaaatggaaaagatagctctatactatggcactattgcacatggagtctccattcgaagtggcagtcctgacactgagatgttttcattctcagtcctaaacttttctactagctgggtccttggtagttttaaaagacaagagagaaaaacttaaaagtacattttttaaacctttcttacagactgttgatttgagtttttgtttacaatgaggatattttagggaaagaatactaatctaggtagtgaattgccataagtataaaaactgttgacttggaagaaaagtggttatgttgtccttaatggtttctgtttaaggcttggagagaagtgcttttcttaatatgtactgcaccaggtaaaggtacaaaaatgtattcttgagtcttgagaagaaatgtggttgatgtaaacctaattgtttgtgaaacgaatggttattacctgttcttgcaaggaggtgatcccatgatggtcaaggaataattttggaggagacgtttaactttaaaaaaaaaaatacaatcattagtttcatgtttgtttaaaagaaactttgttttcctaaccaacatttgagctccattcatctcttgatgcagggagagatgttattgtaaatgtctagttctttatgttactttacagtagggtttttaaaagactgtactcagtagacccactgaaggaattcctaaaaatacgtatgtccccatcccctaaattctaattccagaggtagatttagacactccacaggctgtccttgtgtgtcttttattgaaaacctcttttttataaaattaatctacccaagataacacttcatgaaaacctcttttaaggttaaagattaaaggttaagattaagattaaagatctgcccacgtcggcatagaaacaggtggggttttctgacagggtcttgctctgtcacccaggctggagtgcagtggcatgatcagagctcattgcagcctcgacttcccttgctccagtgatcctcacatgtcagcctcccaagtaactgggactacaggcgcacgttaccacacctggctaatttttgtatttttggtagagacaaggtttcgccatgttgcctaggctggtctcgaggtcctgcactcaagcgatccacctatctcggcctctcaaagtgcaggattacaggcatgagccactgcgcccagcccagaaagagttctaaaatggagaaatatcctcaaatgctgtgttttgttatcatgctttcataatgcacttggtagaaatctcaaagatttcatgtagatcttaaaaataagactgctcatttttaaaatagttaacttctattaaacataagcttgtcagtcataaggtttgaagtacatggaaggtactgtgaatatgaatttagaattacactaaaagaatgtgaatcttggtcatggataaagcagtttatcggctgaaaactccatttttattgtctgtacaaggaaattatgatataggagaattcagcttatctagacagtcttaagtttctaaaaatgcttccttgacctgagacaagatgatggtttcctgtccttttagtgatcacttagatcagtttttaaaaatgtacagtaaacagtggttatactggagcaagtgaagtcaattaggtgcatagattttcacccttaatttgtttatttaaaattttagaaccagaatcattagaatattttagttttgttgtttaatagtgcttaagagcaaatgtttggaaagtaaaaataacttagcagagccttgggttgaaaatcttatttactacccaccaaccctgtaatttcctgctgtttaaatttggacactttggtacattatatattaattgcttaaaagttaatttgttacctttcagtccttaggaagtgaatgaaggaatactttaaaacattaccatatcacccaggattatgcagaaactcatttcactacatcctcatatcatgactctgtttactcccatccccagggcctaagcaaggccctgtaaagcgtcgtcttcagcccccacattcactgctgctcggaaacagcactgctgcactacctttttggaagtgggatctcccacaaatgctgatttctgaggagactccctttgacagctcttgactggtgcccttcaagcagtatgggagccagctaacagtgtggaggtcactggcaccaagctgttctgatgagagtagaacacctgggaaaattttcttctgtccatttcagatgggtggtgtttttccaatgacagaagaaaagtatgtaaaaaatacttaaacccttccctacacttaataggtatggtagtagactcctttgggctcactcattgttcttgcttctcagtaagtgacaatgattaaatatcattcatttttcagtgttaactgtgtaaaattaataactaatgaccaaaaaaaaaaaaaactaatgaccaatttgcattttctccaaatcaaaagaatatactaatactttgctaagtatgatgaaatcagtccttacatgtgtgctttaggaatatgtgtgctttaggaatatgtatgatttttttttaacgataacagaaaaattcaaatgtaaacagaactatataaaattgcttaaacccccatgtagatatcattcagtttaaattagcttattaattcatggatggttattgtttgctctatacgctacttccctctccttaatattttgaagtaaatcttagtcatatcatattatctaaaattaatttaaaattattgaaagactatcttgagttgtataaagatatttgagcaggtgtcttttacaaaacagcagaattctttactgaagctataaaataaggaaaagtgcataaatttatagttcaacaaactgtaaagataattcttgtaaaaaattttattccactaaaattactcatgattttcctttccaaagataaacactattaccatcttgatttatagtcctctagtctttttaagcatagatttatgcacaaatctagatgaagattgcatataaacatatgcattcatagcaccgccactcaagtcaagatatggtattccttactaattgcagtcccctacctcggtctattattctgacatgtgtggtttgaaataatgctttttaaactctttttcatcataaaatagatcagccttaaacatttggaaaatatggcagttctttttatggaaaactcttgcataattaaaaatgattttaacagagaatttaatgataaagaaaaatgcttatgataaaatgtaggaggaaacaggttatataaatgtataatgatatctcagctatataaaaatttaatagaaaaataaaataaaaatcatcgttaaaatttatctcactgtactgttagatcaagctggtattggggttaaatttttatgaataaaataatgtgaatgaaattaattagaagcaactagaatgataggaggcgggaaaggctaagtagttttgcaaagtagagtagctgtgtatggattcaagtgcaataagaaagctggtgttgtcaggttcagattgaaaagataatgttaggtaaaataggtagaagagtttgtaatttgtaaacattatacatgactttctatttaggctaatataaaagtaatttttagtatttatgttcttggtgatattttaacctcattaactctaattgaaatgatagtatagatttgttagttttccttatcacattgtgatgtgttgagtaatgtttgtttcctaatagataaggccttttatgaaagcgcacctaaatcgtgataaagacaaagaacttttaaaattaactcagtacctcaaggagatagcaaaattagatgactttttggatctaaatcacaaatattgggaaaggtaagttttaattgcttatttattttctctttacatcaatgaagaaaaaattatcatttttcatcagtgaccccagtatatatatagctgtcttaatttttatttaaaataggtgacttctaaaaacattttctaatccagtgacctacccccaaaagtattttcccctttcatcttaacctctaacttgttcataaacatacctcttgtaaactctttaatacttctagaagagagaacttgagagactagcatatgttggtgatgctgcctgtaaattattttgtgatgttaggtaagctactcctttatgaatcacatggaatataatccctcttctcatactgtaacttaatgtcaggataagataaaacacatgtaaaaatttcataaatagtattaaaaattaccagtaacttgagtgtagcagagaaattagaaaagtttatcctactaaaaaaacaattactcataattttcctttttaaagataaccactgttaccatcttggtatatagtctttcagtcttttatctaaacccaaatgtttgcacaaatctatatagacgttgcctataaacatcaaggttttgagacagagaaaagtccccagagaagtggaaggtattactatgtattacagtatttgggggggaattagatctttgaggatctggttccagtaatacagcaccaaaagaaactatttgtgtaataataacactttggcttttcagattccacttttgacttttcagatcagtttgacacaagtcttctaagagtctataatcctaataggaagataaagcagacatttttacccccatctttaaattgcaaatgatgtaactgagtcatggagatagtaaatacttagtgcagtgccacaaagtgagcaaattgtaccagcaaaacatgtccaagtttgctgattttaggaactctttccccatccccacaccaccaattatagtagtttgtaaatgttagaaatagagatcaagtttttaatttagtggtagatttctattaaacaatatgaaaaacacttgtttgcttagtaatgtcttatatcttttacactcttgatcaaagacctttagcatcttttgcccactgtcttgatgtaacaaaaataagatctttatggagtttgatctgtatttggaagttacaatactagttaatatagtgactttcacattggaagtaaggcagtatggagtggtagtcaatgagtatgacctctggagccttgttttgaatctaggctcttccactttctagctgtgtgaatttgggcaaattgcttaacctctttgtgcctgtaaaataggaataattctaatagtaactcctcagagctgttgtgaagactaaatgaattaatacatgtacttagaactgtgcgtgcacataatcagtagatgtaagtgactattaagaatactcatcttgaaatgttttgtcattagaacaaactcctttgggagcaaagttaggttatcttcatgaatttagcatgatacagctttgacatctttattttatttcttgcagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttctaaattctgagcggtctcagttaggcctgtatgtgtgtacatgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaacattcgttatctgttctatattaccacatatattttacctctttgttgaatgacaaaatgaacattatattcaggcaaggatctcttgcaaaaacttaaatgtgtatggtgatgttaaaggtgtgtatatcactatttatacattcaggagtagttttagcagctaatcagatacataaaattacttaattctaataagtaccttttttcagaaatatatactattttctttgtgacaggttttgaggatatacagtgcagaagagtttgaggactctaaagtgattcaattaaaatatatttcttaattatgaagtaaaatttaaatatttaaggatagaacagaaattttagagtattcatttttcattggtacatttttcccactgtaaaagacaacttattccaaagtacgcacggaaagggcttaatcttctcaagaaaatggaacacttaaactattaacataggtcaagaacgggcagacattttcgaaatcagtataaactaaaatacaaaagttagcaaatcacagggagcaaagtagaattttacaaaaacatattctgccattaggtggtgcccaaaccaaagcttcttagctgctgtgcttaattaagccactccggagaacattgtcattgagcttgttgagataacgtgctatatgtgattaataccattatagagtgtgggagttttcatttgtcttctgcatctcatggcttattgaacagctccatctctatatatctatgtgtgtggcacacacaattgaatcaatagatcacttaatttggatgcatattttggtgaaaccacaaattatttttatcagatacatgtgttaagcattaaaacagtattatacgaagtatatttagcctaaaaactacagaacatcagtaaatctttgattcagagggaagtttctaatttcccctcaggtctttgttaccgaaatcagttattggactaatgatacctatagcagctcttcagtgtaaaaggtaaggaatggaaaaacaggttgttacagtaagcaactgaaacttattttttattcatggaaagtaaaatagttccttgagaggaagaggaactacaggatagggactgggaaaaaaggatatgcaaaaaaacgcagattagttgcattttaggttattgcttggtttttaggtattaataacaattgggtggtcagaatggtaataaaacatgaataataaacggttgagttttctcatcccaagtactcaacagagctctctcaagggacgaactgttatggtctccaatgaagtattttacatcaaaattcaatcttcttatgaactagcccaagaaatgtctgtgaagattaaatgcttagatatttatgtaaagatttagttttgctacgtgagtcttggtgagacatctgaatattttaaatttttaattgacagttgtttatggggtacaatatagtgttttgatacatatatccaatgtggaatgattgaatcaggctaattagcatattcacctcaaatatttatcatttcctggtagtgaaaacattttaaatcctcttttttagctgttttgaagtatacgttattattaactgtagtcactatgctgtgcaatagatcaccagaatgtattcctcttattaaactgaaactttgtactctttgaccaacatctcatctttccccatccaccaccaccgccctccccaacctctggtaaccgcttttactctctgcttctgtgagtttgactttttagatttctacgtataagtgagatagtattgtgtctctctgtacctggcttatttcatttagcataatgtcctttagcttcattcatgtcacaaatgacagaatttcctgagttttttaaggctgaatagtattcatatatatatacaccatattttaaaaatccattcatcccttgataagtactttgtttttttctatatcttggctattgtaaataatgctgcagtgatcctgggattgcaggcatctcttcagagtgcttagtgtttaaatcttaagagaatctttttgtaatcagtttcatagatttagcaaagacttctgagaaattagtgccttataagaactgaaatcaatacgaagcatcctgtagggctaaaaatggtgtcagttatctagtaatgtcaatgagcttccatgtaaagtgtttaaaatcttgcacacctcccacattaataatttcgtaaaaacactttggaagtaagcaagcacttaaatgcaaacataaggatatttcctgatatgaactgttactcattaaaatgctggtttgcttccaaaaagctttaaaagctgaacttacagcttttaagaacatttgtaaacagtagaaacaaaaccttaaaaatatcaaaaacaaagactgctaagctttaatgatgtttccataaaccaatatggctatgatgaacacacattagtgtatgtgtataatttgttacactaaaggccaaactgatgacttttcaggaatctagaggtaaatcaattatttaattgaatacaaatccctcttacttttattcccagttcttaattctctggagcactgattgctattacttcttgttggataatctgtgaggagaactgctgtagcttcctaaataaggcttttgaaagagccagtggtttgtcagaaaaacatgtgactaaaatccctctttattggcaacaggaccttgggcaagtcacttcaactcatttaacttttgcttccttctacttaaaaaaattctgcacctgtctgcctttcccataggctgtggcaaagtcaaatgagacagttcccatggaaggacttggaagcagcaaaggcttatatgaatgtcagatgttaaaagtagcacagagcatgttgctatcatcgagccctatcattcctgaaatatagttaccaaaagtgaaatcttaaaaggaagacttttcttgataattttacaaatactatcttggttttcctaagatttctaaataatcaaggaaaggagaataaggaaacctctgaagacctagatcttttggtaagtatccagctgcttttacgtctgcaaattccatttagtattggtttggactggaagtccagctgtccctctccctccacccccaaccttaaagtgactatgactgaaccttaacagcattataataccttttttatagtgaaatatttacatgattttaatcttctaactttggaaatcaattgttcccagatagaagcttgcttattttgccatgccatgtaaaaatgaaaagtcattcaaaagcaatgagttttaaaactttttttcttgtaaagatatgctaaggtgtaaacattcatgggttttgtttgtttgtttgttttttctgacaagtttggcagaataaaccatgcaggaagcaggcagtcaacatttaatgtatatttattagttcctactatatctgaggcactgttcttcaagggttaaacacaagatttttctaccctcacagagcttatatttgagtgagggaaacaatgaagaaacaagataatttcaaatagaggtcctataaaaatataataatatgagagaaaatgatggtgattcacattacatgacctaaggtgggaagatggaatttgagctgagatctgaatgaaagccaccatttggaatgtgcagagagaggatgtggaaatcttaaggggcaaataaaaggaagaaatgaaaaaaagtacaaaagtatggagaagaatattgtggaaggcaggatcaaggtaggcagattcaggtaagagtgggaggtaagctgtggcctggtgtgaggtgaggttggagaggcaggcagagcccgtgggaaaggtaggatgttgtacatcaccataagcagtctggcgaattctacgtgaaatgtcaggaaccagtgaagggtgttaagcatagaatgacaatctaattttttttaacagccttattgagatagaatttacatatcacaaatttacccatttgaagtgtgcagttcaatggtttttagtgtatttagagagctgtacaaccatcactgtaagctaattttagaacctgatttatttttaaaaggatcattccggttcttgtgtgagaatgggttatcgaagggcaaaagtagaaaggacaagactcattaggagatgagagatgttcaatgtgaccaggagaaggtatgcatttcttcactcccttgtagcatcatcttccagctacctattgagcccctgtgctataccaggccacgtgtgaggtgccacatcttccatggtaaagaagacagatatgacccctgccctatgggagcatgcagctgcaagactgtgtgcaccacaaacttagcccttccagctttaccactgggtaagtgatgtgatttgaagaatagagaactcaatatatcaaagtcagcatatgacaaatatttctcacccacctatgcccacagtgaaaaagccccctgtgattccacccaacccttctgcccagaggctagacccaggattaagtgtccagcttgggcatgcatggcctatgccagcaggggcacagcagaggtctgcacacataggaagatagatcaaaggcccccttccatttctcctctccagagtgttccagtaagaacatccccttctagctatttcacacatggacaaccaagaaatagtcatttacagagcattttgcatttgtacaatttcactcgttatttctcccccagtacctaatgggggctgcagcgtgtactctgttcgtggttaaattctgctgccagaagtttcctccagctcctgatgccccgaacccctccctccagcattcctgtggctcatcttgcaaactgattcaaaggtgctttgttgcaatctgatctttcaggacacatactgctataaagcttttgaaattttagtcagagcaaaaaacaaaagcaaaaatataagcctaaacatcccctgaggggaaaataatgaaggagctcttaagcactattgcagataatgcttaattttaagaagacatgttttttttaaaagaatgtggactacttcctggtttagacttggaagggtgtacgtgtccagaaatttatctatttcttctagattttctagtttatttacatagaggtgtttctagtattctctgatggtagtctgtatatctgttttggtaccagtaccatgctgttttggttactgtagccttgtagtatagtttgaagtcaggtagcgtgatgcatccagttttgttctttttgcttaggattgtcttggctatgcaggctcttttttgatttcatatgaaatttaaagtagttttttctaattctgtgaagaaagtcaatcgtagcttgatgggggtagcattgaatctataaattactttgggcagtatggccattttcatgagactgattcttcctatccatgagcatggaatgtttttccatttgtttgtgtcctctcttatttccttgagcagtggtttgtagttctccttgaagaggtccttcacatcccttgtaagttgtattcctaggtattttattctctttgtagcaattgtgaatgggagttcactcatgatttggctctctgtttgactattattggtgtataggaatgcttgtgatttttgcacattgattttgtatcctgagactttgctgaagttgcttatcagcttaaggagattttggactgagaagatggggttttctaaatagacagtcatattatctgaaaacagaaacaatttgacttcctctcttcctatttgaataccctctatttctttctcttgcctgatttcccgggccagaacttccaatactatgttgaataggagtggtgagagagggcatccttgtcttgtgccagatttcaaatggaatgcctccagttttttcccattcagtatgatatgggctgtgggtttgtcataaatagctcttattattttgagatacattccatcaatacctagtttgttgagagttttcagcatgaagggttgttgaattttgtcgaaggccttttctgcatctattgagataatcacgtgtttttgtccttggttctgtttatgtgatggattacgtttattgatttgcatatgttgaacctgccttgcatcccagggatgaagccgacttgatcatggtggataagctttttgatgtgctgctggattcggtttgccagtattttattgaggattttcacatcgacgttcatcagggatactggcctgaaattttctttttttggtgtgtttctgccaggttttggtatcagggtgatgctggcctcataaaataagttagggaggattccctctttttctatagtttggaatagtttcagaaggaacggtaccacctcctctttgtacctctggtagaatttgggtgtgaatccatctggtcctgaacttttttgcttggtaggctattaattactgcctcaatttcagaacttgttattggcctgtctagggatttgacttcttccttgtttagtcttgggagggtatatgtggacacatagacacagggaggggaacatcacacactggggcctgtcagagggtgaaaggctaggggagggatagcattaggagaaatacctaatgtagatgtcaggttgatgggtgcagcaaaccaccatggcacgtgtatacctatgtaataaacctggaagttctgcacatgtaccccataacttataataataagaagaaagtggactaaatattctttattttcccttagttggttctttgctcaaagaaaaatttgcatcattgttttggtggatttggtagacctgtttaattaatgtcagacctaatggtttaaaagatcttggagcaaaaaggtgtaataccttttcctcactcattttgaggtccacagccaacatttctataggaaatacaggttagcaagagaaaagcataacaaactcaatcaagtttcatgtgacactggagccttcagaaatgaaggcccaaagacccagggaaaattgcatttttatgcttaggttcaatgaagaatggacagccatgtagaaatgtgattggacaaaaaggttatgctctaacggtaataaacagcggaccccagcaaggcctgtttgttcggattcttcttggcctcttcatacgggattttttccctgctgggtgtggggcaagacccttctggaatgagggtcttatggcctattttcagaggaggtaggtcagagaatgacctctcgaggttttacggcttgcttcgggagagaggggttctagtttctatgacccgctttggagaagagggatcctcattcccatgacctgcttgggaggaaaacgggagaaggagaaaggagtgtggagaaggccaaagggaacttcttgcttccgaggtccttcccatcttttacagttcaaagtactcagcatgccaaagtgtcatgctttggagtatagtgttccgagccttaacaatctttaatagctatacatgattatttttatttttatgggcaatttctatttgtttaagaaatacaatttttttttcattacatgtaatctcaccacccacaggtaacaatggtttacattgtgatatacatccctctgggcttttttctatgcctatgtgtactgataaaatatatgtgcaaaaatggataggtatgtctcagtggctctctgtgcttaaattagtccaaatggttattgttagatgcatatagttgaaagcctcaggaagcaaagactgtatgtctattttttttgtattcttcccaggtacatagtaagcctttgaacttgatagatatatgatcaacctgagttgaattaacaaatgaatgtataaacagacaagccataaaacaggtacttatttaatgtcactattttaataacatttgcttctttaaatgcttccctctgtgatgagagtaatgacaaatatataacacatatttatttcccttttctttttgcatcctggcttattgatttttcagtctaccatttaggaggatatattgatataaggaaaatatttttatgacagcttattacaagagaaaattttaaaattctggttactgatgtaatgttggatgggtgaactactatagctttatgtctccacgatgtatgagggatattttcattcatctcttaaatgcattctgcctttagtgtaatagtcaattgattcatgtagtttacaaatgctttcacaagagaataatagaagggcacaggccaggtgcggtggctcagcctgtaatcctggcactttgggaggccgaggtgggcagttcatgaggtcaggagatcgagaccgtcctggctaacatggtgaaaccccgtctctacttaaaatacaaaaaaaaattagccgggtgtgatggcatgtgcctatagtcccagctacttgggaggctgaggcaggagaatggcgtgaacctgggaggtggagcttgcagtgagccgagattgcgccactgcactccggcctgggtggcaaggcgggactccttctcaaaaaaaaaaatggaagggcacagcaccatatctaaatgccatagttatttatcataaattgttattctctgagaattctgggagcttgagattatcgtccatcctggttaataggacactggtaggtgttatgctggtgctgtcgagcagcaaatcatttaaagccaagtgctacaatttgctggctgccatccagttcactgagtaactaactaagcagtcacacatccaaccccacagtggggtgctgtgaacatgtatggaagccccatatcttcaaggaggtcctaccaggaccacaggttactaaaacttctccgatagtgcccacggtgaacccgtattattgttcctctatcaggtagctcaatatatatgaaaagatagtggaatctgctaggtgatacaggtgagggaagatcctttgatttgagttgatgacaggaattcagctgagtcatgttttaggatgcaggctcatacctagaaccatcttgaaagtaccatctgggagcaagagggcagggcatggatgccctgttgaacatgggctttgaggcgaacagacctgggatggatatctagtcccagagtcgtgtgggatctagggctagaaacttcaccttcctgtattagttttctattgctgcataaccagttaccacatagctggtgtcttataatcacacatttattatcttgtagcttcaacagtcaggatcagcttagctggatcctctgttcagggtctcacaagcctgcaatcaaggtgtcggccagggttgtgtccatctgaaagcttgactgggcaagaatctgcttccagactcctgtggattgttggcagacttcagttccttgaggtcatgtgactgaacgtatgtctgaagcctgtgccttgttgtcagttttagctgccctgaggttcccatgatccttgccacatgagcaaggatccttgccacatgaacctctaatatggctgctttcctacctcaagagagtttctgactccagtatgctgaaatggagttgtcttgcattgcgtgaaataattatggaagtgacatctcatcacgtttgccatattctcttagagtcaagtgacaggtcccacctacactcaggagaggggattacacaaatgtgtgaacagcagaaggtagaaacattgagggttatggtacagtctgtttgccacaatccctgaatccattctttaaaaagttggtataaaaatacctactttagagggttgttatgtgaattcaaaacaagataacatatatcgagtgtttacgtggtacctggcacatagtgagcattcaataaatgtcactgatgatggtaaagatgataatca

SEQ ID NO: 17 - DNA, 42251 bp, Homo sapiens
ctttctctcattgaacatctttttttataattaatgaataatttattttgtttttgttgctgctgtttacctacagctgtttatctcacagcaaatcttgatgtcagcatttggctttgctgtgccaagtgagcagacccaagttcagttcaataacaaatccaaaagcctttgttctctgctattctttgagttatctattccttgaggcaatgaatgactgaatgggggtagggatgcagaggaagaccaagaggtacaaaaaatatatagaaaatttttaaaaaatattttacaattatttaccaactacaaatagcactttttatttattagtgatgaggttcaagacacatcaccccaatatatgagtgtactggactagaatatatcaccccaaaatatgctcctttagcataaggattatgttgatctaattattttaagaaacagcagacctaggagaagctctgaaaacaagagtagaaattacacttttgtaaggaaaatttgcatttacaaaggaaatctccaatttaagggtgttttcctctctgcaccaggaagagaaggatgactgtacatcattatacatgcctaccaatggagaagacactgacttaaatctgcataacaaacctaatgctgttttatggtgttttgcctggccatcttggcaaagctggaccttccccaccccgctcccttttttttgtttcggtagatggaattcaaaccacctcttagagaattactcattttccctgtgtatctcccgtggtataaatgagacatacatgtttgtttttctgtggttaatctgtcttttgttataggaattttagttgtatcagctaaaaatcatgaaaagtagaaaaaaaattattttttctctgctacattagacatgcaataaatatgtgtgtttgaggctgggtgtagtggctcatgtctgtaattccagcactttgggaggtcaaggcaggcggatcacttgaggtcaggagttcgagaccagcgtgaccaacacgatgaaaccttatctctactaaaaatacaaaattagctgggcacagtggtgcatgcctgtaattccagctacttgggaagctgagtgttataaataaacttttggcgccacaaaagaaatagcactcaaacataaatttaattttctcagcaaggcaattttacttctatagaaaagtgtgactcgtggatggagcaatggtgagagcacacctgaacaagggaggggaagggctttttattcctgacacaggtagcccctactgctatgtcgttcccttattggctagggttggaccacacagtctaagataattctgattggctattttaaagagagaaggagaacaagtcggagtggcggggtgagtagtttggtgggaagggcagttacagaaaagagaactcaggatgattcaggtcagagcaggtgaccagggatgactcagatggaacagatgaccaggggtgactcaggacagagcaggtgaccaggggaacagatgtgaactgctgattagaactggtggaaaaagttgtttactgaaactatgggcgaggagaatgaggaagttaaactttaaaatggagaacaaagaactgaacatactgacatactgattctttgaagagaaatttagaactcactgtattcaacatgaggcaggagaatcacttgaaccctggaggtggaggttgcagtgagccgagatcacgccattgcattccagcctgggcaacaagagtgaaactcggtctcaaacaaaacaaaacaaaacaaaacaaaacaaaacaaaacaaaacaaaacatgtttgaatctgcttaacacaacatttttagacggacctcttttgatgttcctaaatcaggctgttaaggactatcttccatgggaaaaggtgacttaagagtggcaatcactgatacagtaaagttctgctttgctgctttgcaaaactttgctttattctcattttctgggggggatgtatcctaagccttaggcaagaattacttaaatttaaaattacacttaggtacatgaatattcatagcagcattagccataatagtaaaaaactggaaacaacccaaatgtccatcaattgataaacgggtaaataaaatgtggcatatcaatgcaatcaaatattgctcaggaacaaaaggaatgaagtactgatacatgctgcaacatgtatgaaccttgaaaatattatgctaagtaaaagaagaaagtcacaaaggaccacatattatataattcaatttatataaaatgtccagaatagacaaacccacagagacagaaagtagattgtggttgcctaggaacatgcagagaaggagggatactgggattgggatttgtgttagtctgttttgcattactataaaagaatacctaaggctgagtagtttgtaaagaagagaggtttatttagctcacagttctgcggctgttcaggaagcacggtgtcagcatccgctctgcttctggtgaggcctcagggagcttacagttatggtggaatgcaaagagggagctggcatatcatatggcaagagaggaagtgagagagaggggagaggccccaggctcctttaaacaattagctgtcacgtaaactaatagagcaagaactcactcatcaccaagaggatggctcaagccattcatgagggttccactcccatgacccaaacagctctcatcaggtcccacttccaacattggggatcaaatttcaacatgagatttggagggacaaatatgcaaaccatatcaggtgttgatggtgaaggggtgctgtgtttctttttggggtattgaaaatattccagaatttattgtggtgatgggagcacaactctgtaagtgtataaaacctgttgaattagacaccttaaaagagtcacttgtagagtatgtgaactatacctcattacagctgttagaaaaatgtataccttggtggtcaaattgtagtagctagtggtggcttcagtttgcggagttagaagagtaaagtcaaatatgagggtttttatattttgggtaactttttcattacctaaaagtgaaattttctctttttgtggatcttaggtggaatgtaatgtaagggagaaaacctttctctctaccctcttaaggtttgatcattgagtctgggaagtaaatagacagtagatagattaacaggaaaaaacaattttaattatgtgcataggcatgggaatctcacaaaagatgagactcaaagaagggctagatgattaaagtttatatagcatcctgagctacagaaaggaattggggcttggagcttaatttgggggtggggcatgacacaaattatgggagggaaaggagaggaaatgcatggtgaataaaagttgtcttgttatgcagataaacagtctccagagtaataaaggttgtcttggagcacccctcagaacaggtgatagtttgtgataatgtctgggcttggcaattaccttcagtctgttctcctcctgtgatacagttaatttttcctaattaatgagattcctggggaggaaactcatggcaattgagtgcctttttggaagatctatctttaggcagacgaggcaagttcagagaccacccttccctgtgcttttgaaacaggggtgagagacagcagggcagaagttcagggaggctttttggttctcccttagttcaaagcactctgcatgaaagccccaaactttggggtatcattttcagagccccaacagtaaacttacaaatttgcctatttgtgtagacttgcctcttgagggtcagtagtcagtatttttcttactcagtgaaatttcaaaatttacagaattgaaatcactcggacttaaattttaaaatgtacttgtgtaaagaagatacatatagtaaaatcctttgaaagcagacattgaatctttctgaaaaatgataggacatttgcagtttttatgtgatgatctagttaaatccatttgatttcttccccctgttctgccttctcttactgtccattcctcttctggtagaaagagttgactgcctgtgtacaggtggcagagttgttttctgttcatcagagtcagtagtagtaaaattcagttgctggattagccaagtgtgctctgaattctgacctcttcaatacaataacattttgcatgactaagtctgtacagtttgttccaaaacattaccctgcaaagcagtctgcaaagcagcttgatccatgcttggacagccatccccagcttggtcctccaggtttgtggacaaggatctgggacactgagggcttgtagagagtagatatggattggattaagcacaaatggcaaccctagactacacaggaaagtcgtagtcggccacaccttgggcttcctatgacagcagcatatcagtgctaacgagccagggcttgcaagccaaggcacaccaatgcatttgcaaactccagagtcaccataagaaagtcatttattccaacgcttgtagagagaggctgcttgtctctaacagtatatgtgcagtgttgaaagtaaatctttagataagttaaatttaaccaaatttaattgagcgaagaatgacttgtcaatagggcagctctcagaaccagcagaagttgagagaactctgctccccgatatgggctgacagcaaatgaacagaaaatggaagtgaggtacagagacagcttggttggttacagctaggtgtttgctttatttgagcatggtctgatcagttggtaacctataattgattggaggtttgctgctgtgttttactgctgaggctcagctattagctacaaaaatatattaaattagctttcagtcagttcataccaagttaggttgcatgcagttcattacatagggactcaaggtatggagtcagcctcagatcaagtttagattaattaaacagtggagagagggcagatgtcagtttcagaatcatggctgattggaaaatgttttccctttctggactttttgggtagggagacctttccttctcagatcctccaaaaggccttcctatctccaccaacaacaactccaagaaatgtctttttatttttaaatacatgctcagagaatacagagaatccaaaagaaggaattaaaaaaaagtaacaaactaagacatagtcattgtcactactttggtatatgttaatgctatctaacagaagtagaaggtgaatgacaaatatgagtcatatatttaattaaaaaatttaatgtagccaggtgcagtgctcttgcccataatcccagcactttgggaggccaagacgggaggactgcttgagcctaggaggtcaagaccaacctgagcaacatagtgagaacccccagctctacaaaacaaaaatactgtactcccattaaaaaaggtttaaaaaggtgaaattaatgttaataatactttaaacttgatatatattattttatcatacaatcaacttaaaaattattattattattattatttttgagacggagtcttgctgttgttggcccgggctagagtgcaatggcatgatcttggctcatggcaacctctgcctcccgggttccagcaattctcctgcctcggcctcccgagtagctgagtttacaggcacctgccaccatgcctggctaatttttgtattttttattagagacagggtttcaccatgttggctaggctggtctcgaactcctgacctcaggtgatccacccacctcggcctcccaaagtgctgggattacagctgtgagccaccgtgcccagcaacttaaaaattattaataggatattttacattctttcatactatctttgttttttattattttattttattttagagacagggtcacccaggtcggagtatactggtgtgatgatagctcactgcagctcggacctctcaggcttaagcaatcctccagcctcggcctcccaagtagctaggacaacagatgtgcaccaccatgctgggctaattgttttgttttttgtagagacagggtctatatgttgtccggcctctttcatattgtctttgagacccagagtgtattttgcatgtacagcacatcccgccatgtttccaactgaggtgctcaatagctgtggctggcgcctattgtactgaccagcacagatggatattgttgtgaatctttaccccaaatttggttcagatgctataccaaaggagggcacacccaggctttctgagcagcttgcccaggtgtgggtgtggtgcagagaggtaagagagagaggcaaggcttaaaagctgtccacagttacacatcaaaaaaaaggagtcagactctatatatacattatattaatatttatatctatctatctatccatccctatatcagacctcaaggaaatatattcaaaactacatgttgaaaaaattaagcagagagaagtagatgggaaggtactaaaaatgcaagacttagcaaaagaaggctgtatatatatagcaaaaggggacacacaacaacccctcccactagcaaatgcagcccaatcattgcccctaaaacagaaccttgcacttgcttctcctttcctgaaatgcgcctcctgccccaaggcacacagcttctccctcacttctttctgttctctgttcaaatctcaccacacctacctcttctgaggggctttccttgttcatgctatctaaattagaggttcctctgcccctgtgattcttaatgttactgcaaagcagctaccacttaaagaatttgtagtctatctcccctgaataaactggaagctcaaaacgggggagttcaggtctgttttgtctgctggtttggccccagaatttagaaaagaggccggcacacagtagattctcagtaaaatagtgttgagtgaatggttgcttaggagaaggaaacagggagggtacttggaaaaaaggagcaagaaggccaccattggtgagaataagtgttttataaaacacaggttatggttttccttctttaagaaaagtagttttgttttcaagtgccaagaataacattaggctactaaggatttctggactgctttggggtttgttttaatgaatagatggaaattacatctatttagcattaatttttatgtgtaagtgggtacacccgaattgaataaaagcagttctcttgaataattaaaacatcctcttcaccctgcaaagcatttagcacactcctctcccaaaaattctattaatggcaactaaaatcataaggtttaaatgcaaaataaagaaggcatttttctttatggtggcacagaagtgaatacctcaaaaccgggcagacccgagagtcagataccaagggttctgtggagtcaacatgatggtctctgataacatcaaaagttaggaatgttttactaaaaagaatataggaagaataaagaattcttgtttacagtagaattcaaactaataaacatagaaagaaggatagaaatagaaaatcaccattaggcgaaattactgttgcttgcaagcaagtatcatctacgtatgacaaaatctgttggtagaagtatgatgagaaaaagggtactaacatagtcttaaagggtctctccacaagatatattaattccaaaagaaaaaaagagtactacaggggagaacactggtggacagacacaacctaaacaaagtgatcaaagttaatttcaccagtactgagagacattgatttcatgcccctcctgatgagattcactgagaagggcacagtattactgctgtaggatgcttgacaaaaatgtagaacccaaatttaatcatgaagaaacatgagacaaatgtcacttgagggacattttacaaaataactgctcctagctcttcaaatgtgtcaaggtaatgcgtggttaaggaagaccaaggaaccttcccagacttgaggtgattatagggcatgaaactaaattcagtgttgtgtcttagattgtatcctggacgaggaaaagcacattggtggaaaaattagcaaaatttgaataaggtctatctattaggtagtagtattgatcaatgttaattttactgttttggataactataccaagtttatgttaacattagagaaacccggtgatagtaatatgggacttctgtgaactattttggccatatttttctaattctgaaattaattcagaatgaaaagttgaaaagaaagtatctttagttggcaatcttctgggaatttgaacaggaactgccaaaatgggagtcaggagacccaggctcaagtttgagccctggcattaatcctggtgtttgggcacggcaccaaactctgtccttctgttttgtcatctataaaactgtgttctgcagaatttaggagtgttgagaagaggccttagggctctcagtggtgaataggggacagggaatgagtgggtgtgaggctccagccagagcagctctgcttttgcctactttatatataggacttcataaaaaactaacttttaattatgcaaaaaatatatattttccttgtaagaaattagaacgttgcagatgcaactaaagcccctttggccaccatactccccaattcctgtgtatcttggaattgcatttaagatttccatttgaacaaagggaccctggctcaaacaagttgggggaccattgggctggttaacccttaaacaccccaaacactcaataaagaggagtttcagggaaatggacaagccatggctggaggatgttctacaaggttgagcagaaacccatgcaataatttgctgaaatagggcattgctctgagtgctgtgattccagggagatgtcactgctgtgtgctggctgtatgcccagcaaagggctggtggctggaaggacatagctttctgagttaggactggaaggcttctgtacatgtccaaagtcaaccttcatattcatggggagggaaaaagaagtgggctttaggattgcctctccttgttggcctgctctgagaaaaacaatcgcgggagggtgaggcgggagaatcgcttgagcccaggagtttgaggctgcaggttagaagctgccgtgagctttgattgtgccactgcactccagcctgggcgatggagcactgggtcctgtgagccttgactcatttaacccccacagcacccagtagatggtggcactattagcatacttgttttagaggtgaggacacacacacaaagagataaggaattgcctaagagcaaaaagctggtaagtggtgagcccaggtgtgagccttgcttcaggatcaagtgcgcacccctgtgctctggactccttccaggtgttgtttctcttgctggcattttaacttcattacacctatctgtatgttggtcgtgggaaggaggaagctcaccgaacactgtggcttacccaagatttgtccctcgactttccctcttcaccaaaccccagagccactggcggaatgttcagttccttggaatcccacatgcccgggttagctccttttgcaagcagcctgatggatagaagtgaagggatggtgctccttatgaaaggagacgggggagcttagtgagcagcggcagggccctgcagcccgtcacacgctagcatccaccgggttgagtggctgcgcacgaccgcggcgggcgggcgggcgcgctgccggaacgctctaggcctcctgcggaacccaggcctgcgtgaaggtaaatgcaaatcagctccgcccagcgcttcccgcagaaggagggttttctgtgtgcgcgtctggtttcctccgccttcagccagaatgctggctttatttttgcggtttatgagcttgagacagggaattcatttccttggtataatatgaccctctggagaaagtcttgtccagatatattttgctcccaaacgccgccctagaagaaggactacactgaaatgaaacggagatgattaaagtctgatttataggtaaggtgaattggtaggattatgccaaattcattacatccagagaaggtgaaagggaatgaaagggctcctcccgggagatggaaacctttgtaaaaataaatatttatggtgcacatacctttaactcagctagtagccaggttatattttattatattcaccaccatttcccttttctgtttctcaccaggctgtacaagccctgaaagcaagaacggggttcacggcatcttgatacccccatgtggggacgttttggcgattttatttacaagaaagggattttacaccggagaggcttttaaatatgctaacagactggaccagctttctcatccccactggctgattaatgattcctccatgccaacccggttctcagagacaccaaggccaggtaaaaaccaccccttcatcccctaaaccttgcaagaagcacagggtccagaattatgcttctttcaggttctaaatagcacaataaaactaataacaataagcttttagttattagatcaggtacattttactttacagtaagcttttacttattggatcaggtacattttaaagcaatttttgaacattatttcatttgatcctcacaaccacactatgaggtaggtactatcattccatttgaaggatgagaaaactgaggctcgaagatgttaaataacttgttcaagatcacagctagtcagtggacatagctgccattcactgagtgcttcctgtgagccaggcacggtgaccatcacattaaaccaattatttatttcatgcaatagtgcccttgatccttaggaagtggcctccagtgcttagaattccaagcatttggtcctctggagatgagaaaccatgggaaggcaggggctcactcacccctgtatccaaaaagttgaggatggtgccaaggacagagacggtaccagggactccaaaaatactgaatgaaaggacagtagaggtgctttcctgtgggatccccaatctctccccgccttcaggtgagtcctgctgatgctcaggctgcccttggaacagggaccttggccatagtttccttatctgtaataatgggatgagaattcctcctgcacagggttgttagggacctcgtgaggcagcttctatggctgcctttggtgcttagttttctcactttcttcttgaacatgggagtggggagacggactcctaagggtatgacacttgaagatttcaggagggggcctgcaggtttatgtcctcacttgttttacacctcacagaggtcagcgaagcagggtatcaccaaagccccacctgatgtctctggaaatcgagtactccgtgtcttcaccaggcccatgccagctgtgaggggcagaaccaggttttctgacaccaaaccccaggtttcttcctgtgctggcatgggtcctttttctgacttggccagcagcctctcatagatgggggtctgattaaatagttctggtgatgggtggagtgatggttgcacaacaatatgaatgtatttaatgccactgaactgtacacctgaaaatggttaaaatgttacattttatgttatgaatatttcaccacaataaaaaaaagaaacaaatatggatctgtctctctcacatgtcaagaaatctggggtaggtagatacagtggttggttcagctgctccatgatgccatgaggatctggagtctggcttttttcttttcttttctttttctttttctttcttttttttttttttgagacaaagtctcactctgttgcccaggctggagtgcaattgtgtgatctctgcttactgcaaactctgcctcctaagttcaagtgattctcctgcctcagcctcccaagtagctgggattataggagtgtaccaccatgcccagctaatgtttgtacttttttggtagagacggggtttcaccatgttgaccaggctggtcttgaactcctgaccttaggtgatctgcccacctcagtctcccaaagtgctgggattacaggcatgagccacagcgcctagcctgaagtctctagcttgagtttttgcatgatggctttcatactgggcacaaggtgtcctctgaagcttctcgagatttttttctgctcaagagaggaggatggaaggaaagggtgatgctagacatggctctgtctttcatcagaaaagccaaagcttctcagcaaccctcccagcagaattttcttatatctcattggccagaactcagtgttttggctttgctgggcaacaaaggtggctgaaaaagtggtcgctaaacttaccaacatttagagctgaagagggcatcggggagaaaacagttgggaatgagtattgattggaaaaccagcaggctgtttccaacaccctgctcaaggtcacaagtctgttatgtaaccatagttgggactggagtctgctcctctgattcccagtcctaagatctttggcttagacatttagtacattttgtagtggctagatttacaataaaaaggacagtcctggagactatctttaaagaagaaaaactctgcattgcatgcactgaaattaatcgaatgctaagaggtcatgtcgcaaaagcactgggcatggtgggagccagaacatctcacctctgccccaggctggccagaaatttggggaaaggtcccagttctcagtgcttatgaaatgtgattagttatttattttttaaaaatctggttagtgttgttcattaaatgtccgttaagtactttggtaactgcagatgaaagaccctgtagggggacaaacacttgttattaacaaccatatgctgtcaagtgtgggcttataacacgggaccatatgctccaaaggttggcaaagaatgacagaagccacccaccattcctccaggccaggagcagagtggcatagggctccaggggacactgaaaatcaggaatgtaaacaaacacccctattataattaccctgccattgcaaggaagcctgaatgtgcacacttggatttttgggatagcaggaaattggactgcattccctctgatcccaccatctcctccttccatgggaagcaccaaggggaatttgcaggccctgcccattctttagcccaaagttggcaccctctcttctctgatgagtcttcctggatggtgctgggttacacagatccttctttttcattctcaccccaggctaccatatatcctgaacattttagcgtgtaatgatagtgaagttaacttttcatcctgccttataagcagtgttaggagtgggcactgtttgggagacacaatgcaaggctttttgaaacttcccaaccctgagggctagcacatgtccatatatacggcaaactctcaataaatactagagctggacctaagagctgagatgtccatggctgtaccaggttagagttttatttcatgattcttgggataccagtagagtcgattccaggatagagggtggaataagtgagagcttccacccctaaaaaaggcacaatgcagttcagtgcccttgcaaaggatccttccttgtcagattacagggacatcccctgagctcaggaagacactgactttggaaatactataaggggaaagagcaactctgcaaaatttggaatgggatcacttcaagaaagggcaatgcttaaatgataggggaaaaaatgcacccctggtagacttgcaagcagagtactcaaatcagctgagaatgcccaaaatatgattacaaagaagagtttttattagttcagcctcagaatgcaaaaataaataaataaataaacaaacaggaaacaaatgtaatcactttacagagcgcacatacattacttaaaagtagcaccttcatggagccatattttctggtcataattgtgtatcaggttcattcatgctaatgagaaagggattccagattttctttgcatctgtctgcttctcacagggctgttaagaagccacctgccattctgacaatttcatgtccttagccataactacttgtcctctctcttgaatcttaagatctttttgccttccagacacttacggtgtttctgtgtcatcctcctgtgtcttttagagaggtgggggtgaggactgccatggaagctaaagctgaattttaatttcaatcatttttttttttgagacagggtctcattctgtcacctaggctggtatgcagtggcacaatcacggctcaccatagccttgacctcctgggctcaagagatcctcctgcctcatcctcctgaacagctgggaccacaagcatgagccaccacgcctggctaattttaaattttttttgtagagacggggtcttgttatgtttcccaggctggtcaatcatttttttctagcccttttaaaattcaggcatccaaagattaaacttgcttagaagtgtaagtggccctaaattgctttatcaacaccatctccaggaagtcttcacagacatgggaactagcatcttgttctcctggatcttctcaacaggtttgcattgtcaggtttccatgtaagtatctcttgcgttcccatccatcacaagtgtatgatggcactggtatcagaacactgcattcttcctgattgtcataaaactgatgtacttgcagccttgcttgaaaagttgtcagtacaaataaaattaaattcacattttgcataatagggactgatcctgatggatcaggtcataagagtatgaaacattccatacatcctggcagacaaacgttaaataacagtaatatactaataaatacataaattacttaaatatttaaatagcatgaaggcccatggcaacttgagagctggaaaatctatacataaattagctgattgtttcaatgagcatttagcatctaactatacaaatacagcaaagatatcattgtgatcctaaaaaaacgttttaaagcaaatcagatagaaattatctttttgggtctattccgttgtgtctttaaacattttgcttaatatcttccacttttcctccaaattttcatcctggatcagaacctggaagagaatgccaaaagttgatgtggggtgacattgtaacagcaatgtctcttcttatttctcacaacatatgatcctgggcaactgggtttcagggatttcatgccagaaggcccaggccttccttatgtggcctggaatttggctggcaccatgcttgccagaggctttcttgagggttttcttaaaataatatctgattgtgttacttccttgctgaaaacccttcagtgggtttcagggcccggggcccccagaacaagattctgagtcctgcaagcttgcaagtcctccatgctctgcctcctggctacctctctcttttctttgcctttctctttaggaggccagaaccccggtctgttttctttcctgcaatatccctgtggccagcacagtgtcctacataacaaaggcaccaaataaatatctgttagtgaataaatgtatgtttctgattctggcaactgggtgctggccactccatccccctttcctctccaacacagcccccaatcatatccctgcatccaggtgcactgagagtgcaggcctgggctggcctttgagggcctgctcacctaactgcagggcacagatgcccattcgctccaagatgagctatagtagcggtcctgggcccgcacgctaatgctggcatttttgcggcagatgaccgtggctgaggtcttgtccgtgaagactctatctttctgcaaaagagaaggaaagctgtgaagaccccttggcaacatagtcacagggtaagctgagcctgtttctgcaatgcatactctcccaaaacaagcccatcttggtcttagggcactgtgcttgcaattcacaggggtgtgcatagaacttgcaccacctactggcagacactccacatgtaggtgcagcttttgtactttgtaagcccttgagggagaaatcgtttggcccagctttcatctttctagcacaattgccttgcctcaagaccccatggccactcacccagtcctgagctgatggtgagagagagacagatttgctctagccatccctgagatattgagaaataccatatcctgatcatttcatcagaaaacttgccttcaaattctggcactgctacttaatagctgtgtaacttcaggaaaatgtcttaggttctctgtgtctgtttcctcacttataaatagggataacaataatgcctacttcatagaattatagttcaaggtaaaaatcacgtcaaactcttagcaagtctttagcacataggaagcactcaatatcacctattagtcatacagatcttaaatagggaaagtacttgccaagatgtaaaataatatttaggtaaatatctattccaggatagcctccctacctaattattttcccagagagtaactagctcactgaatttctaccacatgctaaatgctatgctgaattagggctttgtccagtgattttaaaagtggggtgaaaggagtctggggcggtacaaaagggcctctggaaccttgcaacaggcaaaggaattctgctgtaaggtgaggaagctgggaagccaatatcttagcctctataagtgtagacattctgtttagtaaaataattttataatatctggaacagccaggagctatccattttgggggcgatatctcttgcctgttctatcattcattacatgcactcagttgaaacaacaattttaggcttctggagcccaggtctcctctatcaggactaattctgagtgccaagatcaatgaccaacatcagaggtagtggagtggttaggtgcatggcctttctgtctggcagattgagtttatgtcttggttatgtcatttcctagctgggtgaccttggtaaagtcacttaacctctctgagtcttcaatcacttgtgaaatgatgataatactactggctaccaaccatccttttcttggggttgggctactgtccaatgagcacgtagtgagggcagtgctgctaacacctacacaaaattcctgcatcagctacagctttactttaccttgccacagtttctggaaaaaaggaaagcctcttttccacaaaaaagggggtaaaaaaacaagaataacatcagctacctttgttgcgttaattttgtagattaagtgaaataaacatggaaaacccttggcacagctctagacacatagaaaagtgctaagaaaagtaattatgcatcacataataacatttcagtcaaagaaggatcacatatatgaccagtggtcctatattgttataatattgtatttttgctatatcttttctgtttagatatacaaaccattgtgttgtaattgcctacagtattcagtacaggaacatgctgtacaggtttgcagcctaggagcaataggctataccataaagcctagaagcgtagtaggctataccatctaggtttgtgtgggtacaccatatatgtttgcacaatgatatagctgcctaaagatgaatttctcagaatgtatccctgttgttaagtgatacatggatgtcattgttattatcatcattcatcttctcactttatggtgggcctccgtaaaactgaccaaggaatatactgcacctgaatcacttcttaccttttctctcttgctcttgccctggacctgaacgcagaatgtcagggagaagtaggaatgtggagtactccaggtgtcagggtactcccagctgacctccacctgccgagaattctttaatggcttcagctgcaagttcttgggtgggtcaggtttgactgtggaagaggataaacatgctttattttcctaataaggctttggagttcagtggttttggcttatgatctcacttgcacctttgatcagctgtgagtccactggatagttacttaacttctgtgagcacctggctggcaaatgtgaggcacctctgccgcaggtgctcacgctggtgcctcgggaaggcagtcattatcaatggccacatctcagatccacatgtattgcaggatctgagagatgctcagaatcctcatcactgaacaatcagatgggaccgcacagtgagaagacctctgctttaatggttatgggccatgcattgaaggaccaccctgtctgtgctaatccctcactttgcactgaacatggaactaagctgagcctctccctggggatgagatgatagattttctatttactgccctttcttttgtcttttcatagcttttggtgcggacatgtcttggagcagttacagtcaattgtctctatgctcaatttgcttgtttattccatgaatactgagcgcccattatgttccagccactggactgtgcatgaaggatacagcagtgagtttcacaaagactccttcctcaattaggtcttctagataagaggaggcagagacatgctagggtgtgtggttgggctctgtaggcctggcactgctccacacaaagatcacggctcctagcaggtgcttcgcacatatgcttccctctgctcttaacacaactgacatctttccttttggtgtcagctaaatgtcacctcctcagagaggccttccttggccaccctatgtgaactagaccccacccaccaagtacaaaccctccataagttttgaagcaagttctctggttctattacactttatcatgctgcctggtcaatgaataaatagtaaaggaaatgacttatggtgaaatccctatctgccaattaaaaaaaaagatgtccattttggaagggtttatattctaagaaagaagtcccttttcaaatgctaaggaaggattggttgggaataattgccattagtaaggaagccctggttctgaatatgaatattatgcttgattaggctctgggattcatcatggaaactatctggcagctgaatcaaagtgcagtaaagagcagctgtagtggagtggatctggatttgaacggctagctgtaagatctgagatctggggcaagttgcttaacttttctaagactcaatttcctcttccttaaaatgcagataacagtatctacatcgtattttgtttttggatgcagaataaaagagatgatgcttgtcaaccacctaccccacagtgcatggggcattgtgaacacgtgacaaatagtatctttccttatggagcacatataatcatccaaaactcactgatgtccctgatgaagaagctgctggtgtagttttcatacttgagcttgtgaacggcatccaccatgacctcaatgggcagactctcctcagcagctgggcaggcactgtcctcctggcactccactgagtactcatactccttgttgtcccctctgactctctctgcagagagtgtagcagctccgcacgtcaccccttgggggtcagaagagctgaagtcaaagacagaaattagcctgtgttacacattggggagagagttcctagtgattgtagccagtaaggcaggtaaggcctcaactgttgtctgaggacacagtttctccaactgggctgatttctacccagagggtaagaaactgccctccccaggagaaaaagcttaaattcaagagcacttacatgtctctggactaaatgaatatggaagtttttgtttgttttagatctagaatctctgattattaaacccccttgttaaaaacttaaattcattttttcccattttaattataaaatcaatacacaaatcagtacacactaattataaaagtaaagatgataaagatccatataaaggaaagaagtgtatgtctccttcatccttaactgctctccacaggtttaagtactaataatagcttgttgtatccttccagaccttcctttttctttttctttctctctctctctctctttttttttttaagagacagggttttgctctgccacccaggctggagtgaagtggtggaatcagaccccactgtagcctcaaactcctaggctcaagtgatcccctccctctgcctcccaagtagctgggactacaggtgtgtgccaccacacccacctaatttttttatttttaatattttctgagatggggtctcactgtgttgcctaggctggtcttgaactcctggcctcaagcaatcattctgtctcagcctcccaaagagttaggatttcaggtgtgagccactgtgcctggccagaactttttcaatgaatattcaagataattgtatacacattttatatatatatatatatatacacacacacacacacacacatatgtatacacacattatatatataatccatgttatatacatctctacattatatatatccactatatatattttacttatacatatagattttatttttatgaactaggatcaaattgtatacatatgattatgtaaccatccttttcccctctgaacatattatggggagctctccatgacaaaacatatgggttgggttatccacttcaatgactgcacattaagcaagagtatagtgtaccatgttttatttaaccattcctctgctgattatgtctttatgcacttggagaaacatttctttagtaagcattttccttttaaagatgaaaaagtgagaccccaatgcttaatttactcagtgaaataatggtaaagtcaggatgatcacctggggtttgcttcggtgatgattaaagtaagccacatgggggttaacacataggtcttgtatttatggaagttgctttcttacggaaagtccaggtgcattggaccaacagcgaacttcagattagtggtgtcagcagaagtaaaaggagttgaggtggccctgggaaaatttcgggaggcctcatcgagttttggagtctgcttcagggcccctaagatctacgccctggagctcttgtttttatttttgactcaaggtgcaatttcagcaagtcatttgtagctttgaattctccgtttatccctttctttggtgctatgaggcttcaggaagcatggccaggcaatttggatgagtgggttcaaacacagcagagactattctcagttcccaataatatcctgccccaacacatacatttattcaagcaatcggctaaaatctccatgttctttcttcaatgtagacaaggaagggcggttgaaaaaacacgggtttgactttgcttttcccattatcattaactgataggtcactgagaggttgcccttaatttcttaatgaaatagttctagaaaaatgctgagaaaccagagcagtttcactcaccctctgctgcttttgacactgaatgtcaaatcagtactgattgtcgtcagccaccagcaggtgaaacgtccagaataattcttggcctcgcatcttagaaaggtcttatttttgggttctggatttgaaaaaaacaaaaattcaatatttaggagttttttgcagaaaggttttgattgtgatgaatcacagatcaccagatggtacagggtgaagttcttccatgcgttgcctcttgggtagctccataaggattgggagtatcccagtggggtgttgattctgcagagtacactacacacctaacatgcctggcagaggcattcattttttgaaggctatcaccccagtgcagagtgatacactatcggttaatttccattagccattaaataatatcaccattatttaaagaaaacatgaggctaagcattcagactgatcatgaaactcccttaatatgagattttgatggttgataacccaaagggtccaggaaagcaaaggaaaatggaggttaacatcaattaacatcaataagagacttgatgttaattcattacactcaccatgacttggcttttcaatttgttgttgttgttgtttttaactcttatgagcgaaagagaaaattgatactatccaagggtatagaattacctttctggtcctttaaaatatcagtggaccaaattccatcttcctttttgtgaagcagcaggagcgaatggcttagaacctcgcctcctttgtgacaggtgtactggccagcatctccaaactctttgacttggatggtcagggttttgccagagcctaagacctcactgctctggtccaaggtccaggtgataccatcttcttcaggggtgtcacaggtgaggaccaccatttctccaggggcatccggataccaatccaattctacgacataaactggaatgcacataaagtggagaaccaggctgtaagctccaggaactctgggactgtgttttattaacccttcgggcatccccattgcctaaacacaaccttgtttacaacaagtatttggcaaatgcttgctgagatgatctcaaggcatgagaccctgcttgggctcaaggtcatggaaaagagaaacaaagagttttatagctgccatcgactcattgactggaaggctgcctttaatagtaacctttgattatttagcagattggaaacaccttaatataccaaaaactgcaaacagcacaagactctttgccaaaggtctgggggagagaaacttccagcacaatttcagtttcatagagaatacggcagggcacaatattcagcagagtaacatagtggttaaaagctcagggtgtcgagaacaacgaaccaagactgtcatcctgtctccactaaccagctgggggatttggaacaaggtatttcattatcatgagcctcagtttcctcatctgtaaaatgataataataacagtatctgccttacatttgactgaggattaaatgaaaaaaaaaaaaagcacgtaaagtacttagcacagtgtctgccacacagtaaattcggtgttagttatcgttacttatagactgaggagtcagccaactgtacagagaaactctcttaacaattttccatggatatttaaggatttcgttccctctgttttaaatcaccagtggagattttcattctctctgcattattattattattattattatttttagctatcttacactcttatgaagcagtccagtagagcttagtcttcccatttaatgaagaagcgtactgaggccaacgatctaagcatggtcacagcaagtcagaagtacaagggctacagctcagaccttttgtctcttgggctttgcaagggatgcctaatgctagtgtctaaactggcctttgaggaatggcttagtatagtatttcagagtgtgtcatagcaaagcttcattcatttttttaatccatgcataaattattaattgaatagaattgtttaatgtagtagttcccaaagcatgatcgatgaaacaccatcagcagcatcaccttggaatagatcagaaatgcaaattctcagctgctgaatcagaaaccttgggatggatttagttatatggttcttaagctctccagatggtgctgatgcctgctcaagtttatgagtcacagtggttgagagcctgcattttggagtggcagaggcctggatttagaagcagctctagcccttgctccagtcttgtggcctttggcaagacattcaactactgtaagcctcagtgtcatcatctttaaaatgagaaaaatattagcccttgctttagaaggtggatatgtggattatataagctcatacacagtgcccttacatgctttataaatggtggttctcgttattggcctctggatgtaaagcattgtagaatataaagttttcactttacatcaattggattataaggactgaatggataacaaaaataagaggtcaaaagcatttggggtccaactctggggaaatgattagctgtgctgatgtaaaaccatgtggcacttttggctttttcttggttttttttttgtccccctgacacctgaagagcatggttactttcctgtcccaactgaggctcggaagccctagaagatgtttgctcaacagcagggaaaacagctgcaggaggaaagctgaagaggagcatcaagaacctggcacttagcctcactgcatcgtctgccctcctaagtcacacctcggagagtttctcacactgattttctggaatttctgtggtttaccaaatcagaagtcactaaggggtcaaatatgccaggaccaaggttcctgagctcgctaacaatcccagggttggaagggatctgccatatacccctggctcaggcctttgcctttacttaagagagtgtctaaatctctcaaattctcatggagaaggggtggctggattctgtcttcctaaaattcttgagaagagaggagtggtcccagatttctttcaggtacccatttcaagatggtactttctagaatatcaaaagattatttctgatcatcagctgaaatattttcatccttaatttatgtccatttcctcttattcagctctccaaagacctgggaaaaaattacttcatgtccttgtaaaaacgttttcacaaatttaagtgcaccagctttgaagcaagacagaattgggatcaagtccctgttccacccttaccaggtatgtgacattgggcaagttacttaatctctctggcctcagtttccaacatctgtaaaatgggatacagacagtctctacttcatatggctcttgtgagaattaagtgagacagtgcactcaataaacattaactattattattatacaattaaagatagtaatcgccaacattatgatgttggcttcagtgataaaaatctgagggtctttcaggtacagccaacggtcagaatgcacatttactgagtgtgagatactagaaggatgggcagaactccttattttaccattaactattctattagtctactaataatttttactgatcattgggataataaaaagtatctcttgaatcatgaaagatattttaaacaaccaaaatagtaatactagctgacatttactttcactttactatctgtcgagttgtattctgcattcattaacccactaaataacccacgtggtaggcatccactttgtaacatccagtttacagttgaggaaattcaggattagaggtgacccagcttaaagtcacataaccagtcattgacagacctaggacttgaacccaagtcaatgtgagtctgaatcctatgcttcctccaaagtgcttggtcagaggtaagtcatcacagtgccaactgagggggcagtatcatgtggtggaatgagaaacgaacacagttgttatactttgcaaatcctctactttggaattttaattgtgtgaaacagtttttagtaatattggaaaatatcatatgtcatatgtctttccccaccatatcatatatcatatgtctttccccaccatagtgtaccaatgtcatccaatgtgaaaaccaaacaatatagataccatcaaagtagaaaagagagatatggcattgcattttcccagagtgatggctttctctagaggacccagtgcatggttgcccatttcagtttgatttcccaccagtggctgcccaagagtcctggcttagaagtggggcctccacagagaataatgagaggctggttaccatctttcttcagttcccatatggccacgaggggagatgccagaaaaaccagggaaaaccaagagatgaccaactgctggtgacacatctataagaagggagagaagcagggggaagagaaggaggaaaagagaaggaagaggaagaaaaaagagaagaaagaatgtcaataattcttgttacctttgtgaaccatatacacattctagctactttttttttaaataaaatcttgattctcccctttcttctccatactgtcaagcaaatactaagtaaattacaggagttctatggcagtctgtggggaagaacatctctaaatagagaaccatagggtatttggggctctggagctgaaagagacctaaggcaagccatctgatacaatcctcttatttttaagatgagaaacttaaagcttagagaaggaatgtgactttctggatcaacatctagcagttgtttatttagtgcttactacataaagagcactgggctagaagcagttgagagagaaaaaaagggcttacctggatcccgcttcctaggagcaaatacttttactcaataaatatttattaagtcagtgtgttaaatgcctccccgccagctggggagatgagccatacatttgtatcactgcagcacaaagcagtgtgtgctggagcacccagaactgaaggacttgggttagggacaggaacggtaatacagaggcgaactttcaggttctggcaacgacctggtcaccagcccttgctgtaggggtttagcttctcttgttttccaagttcaaagactactctctcccatatagagaacctagtggttctaaaatttgagtgactgtcaggataacctggaagcactgctacaacagacggctgagtcccacccccagagtgtctgattcagcaggcatgagggcctgagaatatgcatttctagaaagtttccaggggaagcagatgctgctggcgctaagaccacaccttgagaaccactggtttaacccatgttcagggtccagaacccctgaaaatcaaagtgttcattgggaaaagaccacaacatattgatatatccaccatgaaatagtaaaatgcataattttatgttaaataagccaccatctgatatagaaaccagtctaggttagtatccagggtttatgaaaatcttccgattgcaaaaattacatgccacttacgaatgaggtagggatgattattgaaacattctgaaacaactccattcaccttgcagagcacccatggtctggaggaaagtggttctgaaaccactgttttaaactatatgaagggcaatgctcaactgtttcagtcaaataccttaaaaatgagcattcctgggttgggtgacggaatattgacaaattacagctttgtcagaactgctactaactctaggcggaccttgctatgtactttattcccttataaagtttgtgagtggcagagacaggcctagaagtcaagccttcttggacactgctcagtgctgtcaccacagcatggagttttaggggcatggctatcacttcagtctaggttatgactgtagcaaagtactagctggcacagggcaccggttagtacattcacaggcttgaagttaaacagacacaggcttgaattttggtcccaccgctcatttgctgttgagcagtgggagcaacttgttggccaagttactcgctgagcctcagtctctttgtctataaaatggacctaatacttatctcaaaggcttgttgggaaaggcaatgagataacatattatagaaggcaaccaataacatattaacttgaacctagaggaagaggtaagggaacaattcggtatctgtgttttatatatcatggatagtcaagaaagtcattctaggcagtagggaaatgtgcacagaggtactgcaattacatgcgcctgtaaaacccagaggctggcacactggaagggaaatagtggagattcctggcatctcctggccacttacgctgaggtattcccactagctgtgtgcccagcacttcctctgcatgcctcagatgcatttgacaatctcaggtgaactgcacttcagggtcaagggaaccccggccatggttctaagaagcaactcccattttagtatcacctacatttgaaaccacagagcactgtccaggagaggtgatggtggtgggtctcctcctttggctctctggcccatcagctgatactagggagcgctatccctcagcccacatttctcagcatggtaagtctgagagtcttgatgattaaaacacatttttgtgtgtgcaatttcataggttttctaaactcttgaaacccttgcatgaaggacaaagggaccccacgttacacactcctacttcctggagtatgctaagggcttcccaacactggtgccaacatcagcatgccaatgacgcttgggtgggcatctcttttttaagttttgtttgttacctttaattagaaaagggagttattattaaagaataaaaagatatagtcacagatggcatgggtggcacatgcaaagatccctagtttgagggccaggcagacttctagaactgtgtgactctgggtgagtcacttggcccctttaagccccacactcctgatctataaaatgggcatgctactgtggtaaggagttagtgacataattcacgtgaagtgtcatggtgcctagatgaagtcaggacccactatttgctcccctccttccacagcatttactacaatggcaacaatacagtctcttctttactgtttgtcttctctgccacactgagtgaactctcttatgccatggatcatgtctatcttgttttgcactttacccccagagtccagcacagagggattccatgacttattagtagcatgaaggaatgtacggaaatcatacaatttcagattccagtaaactaaactctaagaggttacccacattccatctagtatcttgcaattccttgtttgaaaaagtgggtcatcacctggggtttagtaatccctttgttaaaatgacattgttgttgcacacaattttacctgggcaagtaaaaaaacctttttttcccccttctcacagatttaaaaactctttaggaagcaataatagcttttcattttttaactggggccaaagttagttaatccacaagaatggggatcccagctgtcattttggttgatatcacaactgacgaccaagaccatcacaaatatgggagcaagtctgatttgtaacattattataattatgaatccaattactttaaggaatgcacgaaaggctttttaaaaatttcaatagtaaggcaggcaccactcactttagctctatacaatcctttaactgatgggcattaacatttaggaatatacttttatacatcaatacacaccacttcaaaataagataaaacaaacatttccacaaactatgcatacacacagatcttgctatacagttattattaggtggcttttaaaatggacactgtacatcggtccctagagtactaagttttcactaatgttccagcagatgactcaccagggatgcttccaggaatccaccaactccctcctgccagctgctggggtagcacactaacggtttctacacctggacagctgcaggcccacagggaggggagggaggtaggggcttgggaagtgcttaccttgctctgggcaggacggagagtccaatggccctgaaacagatgttgtttcttctgctgctgttgctggtactggaacttatatactctactcctttctgatggaaacttaaactagaaactgacttgttgcaacattgaaaacaactctcaaaaccttctgggggaatttcaagaagttccttttttgtttgtctctctctgtgtgtgtatcaataacgaggagggaacatagacatcaaaatcccaggtaatgaactaagaggaaatgacttttgggtggggaataaggaaggagatggagatgctaatttctctgggtttacatcatggccaaggtgcttggagacagcactaggcagattccctgggttccacagatcgaggaagaaggaaggccaaggggcggtcagacgggaggctgagttcatgtcgggatggaacaactgtatgcccaagggcttaaaaacaaaatcctggttcttcccaagtcagagaggatgagatgaagggcaaagggtttagtacatctggggcgccttcctccacattagtcctttaatttcagaaacatactatttaccacccatcttggctccatgcacctctccccacattccccgagtgggaacacacgcgtgcacacacacacccatgcacatttcatacagacacagacctggggagatgataaaactgcgtgtaccactaataagactcaaatatgtgcacatcctgtgctcataggtactcgctcataggggcggatgggagcagaaagtgaaataccctcagggaggcatacagacaaccacactcaaggcacccccccttgggcacccagactacatcctcatttcatttgcacacaaatctatggccctaggggctccgtgcagatgcacaggaatagcggaataaagatatctctcgtggtggaatttcaagttgctaagaggtatgcaaaggtgtacaccggtgtggacccccccatcccccgcccagtctgcacgtgaacaggaacatgtacctgcacgtataccaggtacacgcagacagatgcgggccatccccagagccgccgacagaggtcgctgcgagacggtacccgcgccccacagtccacccgctcctcggagtccccccgcgccccggagtccacccgcgccccggagtccacccgcgcaggtccacttctccatccctgctctcgacctccgcccctgcggtgggggaagttcctggggcggtggctgggaccaggccgggttttaggcgggcgcagatttccgggctaactttcctcgccgtctcagcgcgggaagggggaaatgggaaacccgggccagagcagcggagcttcccagccgcacacttcctccctccagccgtttgtctcggcaggggagggcccaggcagccaagccggcaggcccactggttatccgaccttgtgctctggccgtgggtggagaccttacatccagctcagagcgcctcctcccatcccctgtgtcctctaggcctccccagactttgccttttagccttccagtgaaacaagttctgtatccaagatatacaattaagtggacaaagcagattgcaggtatgttttttcgtatgataccatttgtggggtgtgtgtgcgtatgtgtgtaagtgcacctgcacttttcacaactggtatctctgaggcatatgtaacaactgggggaggggctttttgtaaacatgtattaatttcctccgatccatcactaaagtgtactgaacagaaattgacgtgaagtagtttcactaatttatttacagtggctgcaccaccacagatgagtccttgtgcccccccataaataaatacatgcataaaataagacaagtaaggttcaaaatgacacaaatattttattcatgtgttcgtaaaagcaccttgaaaattaaaaaaaaaaaactgtaacgtaaagtctcagtaaaaatccagcgccagttatgcaaaagaagcttcgaagtatgccctcatcctcccttttccgctcagattgcagcccgagggctagtcctatatgaaagggcccccagtgttcacctccaccagggacaagtaatagggttttaagagcatgggctctggagttagagagctggatacccgcacctgcaagttacttaccttcgttaagcctcagttcctcacatctgtaaaatcgggttaataatagtacctgatctcaggactggtgtgaagattaatgagatatgatgggatgcagttaaagcagcatcctggctaaacgtttaatgaatggctgcttgcacttatttatttttttatcctgtcgtgtcccagaaagtcttttcgtagctcacaaggggacatcaaagatgacaaagaggagtggaagaagacagagagaatcaatgtgaggagcctggaacagggctctgaattgtcttcccacagtgaaatcacttgtctattgctgagccaagaatttgactctgagcatctaggatgagaaagaagaactggcacctacgccatctctgcccctcgggactgactattttggtaagttcagttcacccatggaggaagtggttctcgtactttatctgcatgtaacaacaaaattcaggttcttggggctgatgcttggagattgtgattcagatctgggatggggctcaggaacctgcattttaacaatggaggttctaatgtggtcattggcaggttgttctaatgtgggggccacattagagcctctctcggagacaggctgtacatggccagccagcattctggtaatatgagccaaatgcccattgacctaattttggagaagaggtttatcaacatgtcccacttcacaatccagaccctgatcccaggcaaaataaactgatacctataagctttctattgcttaccctatgggcgaggaaggtctgctgacaaacagagggcgtgctgagctgcaaggttaatgtgtctgatgattaagctgtgacatggaggcaaccccctaaaaaccaaaaataacttaaagaatttttttggccacaaaaacttattttctcctagaagaatgctttgatcatctagtacacatttcaaataaaggagaagccatgtgtacttataaaaattaaaatcttagaaaattacataagcaatacatgcatgcatgctattgtaaaaacttcaaacaatacaaatatacatagaatacaatgttgaggccctgattcctgtggcttccagaggttaccagtgccagcattcctgcagagcttctgaatgcttctctatgtatttatatctatctggctatataaatggaatcatactatacatattgttctgcaagttgctcttttcttgcaacagtctattttgtattcagtcacttgcagtgacttgctagaggtcacttgaacagatttcacgtctgcatcaattaggttgccctgggcttagttttctaaggagctctgcagttccaggcatcaatccactaaggactgataacacctgggataagaaaagactatcttgtcctgttgatgtctcttaggagcaaataatttgccctacaagctccatagccttttcatgaagtctcacttatcacctgtataccactccctgacaaggagaatgggcttattacaaggaaagtgatagacaaggcaggtttgccctactagatggaaagtggtaggccattgagagtcatgaaaccaccctcacagggttgacaagaattgcatgctgggttctggacaggaatatagttataattaagcattgattaggttgcacgttggcccacttccttgttgctcaaagtcacgtagcactagatcctgaccatttgcatctgcattattcctgtagataggatttctgacattagggtcataagattgtgtaggaattgatttgtatccctattgttcctttagatgggatctctgacattacaatcagaacgcttttgtttaagaatcacttaagttgtttttcaggtccccaattctaccatatttcagtttgaaaacccccacaaagaaaggggatcaggttgaaaatacagcttcaccctgtcccatgacttcaccatgcactcttcaaccagtcaaccatctccaacacatcagcccactcccaaactcttaaaaaccctagccccaaatgccacaaggagatagatttaaggtttcttcctgtctcctcatttggtgaccctacgattaaacctctttctctgctgcaacctggcctctcggcgtattgacttgctgtgtgcaatgggcaatgaacctattatggatacagtcacatgtgtctgttacatgagtccaagtgatttgtgcggccagtgaagtgcagaaatagggcaattgtgtggataatgaaaactaaggcttcttcccccaaatggtcagttgcttttgaagggatacttctagcctaggagtatgggaagtagcttctacctcctgcctcatacatacatgctcttaccaaaagaagagtggaagtgtcacggcagatagctagtcagacatgagcagggcagaagagggttcccccgccactccccgcccaccaccactaggaatgtcaggcaaccatcaggtgagggtcagatggttattaaactgtttctctaaaataataattggtcacagctggtaccagggaaaggcagtctcccaatagatagaacacctgaagctggtgattagcagcttccggataagatcttaggagctgggcgaatgggcttaagcatgagcactaggagggaaaatggtcgaatttaactggtgtatgagcttcttctaagaacactcaactagtaagggaagaatgcctcaagtgaacatgcgtacaatttcagtaaacatactgtgtatgtggcccctcccaagtgctggcaggccaccccaagagaagaatcaggggagaagggaggcaaccccccagaagcatgccagcatatgcaaccccaaatcaaaggttaaaccatacacttgaatctctcaagtcaccctccctcttccaagtgtacttccttttgttcctgctctaaaactttctctttttttttaactttttttttgagatggaatcgtgctctgtctcccaggctggagtgcagtggcgcaatctcggctcactgcaacctccacctcctgggttcaagccattctcgtgcctcagcctcctgagtagctgagattacagctaccacgcccggctaatttttgtatttttagtagagatggggtctcaccaggttggccaggatgttctcgaactcctgacctcaagtgattcacccgcctcggcctcccaaagtgctgggattacaggcatgagccactgtgtctggcctcctgctctaaaactttttaaataaactttccctcctgctctaaaacttgcctgggtctctcactctgtcttaagccctttggtcaaattctttcttctgagtaatagggacaggagacagagaaattctaggcagaaaagagtgggggtttttggcaaagacccaccctcaagcctggtgctgtggcccaaagtgagaacatgtagtcctgttttcccactccaatgttgccgtttcccaaaccacccatggcccaccctgcccccacattctgcacccataaaaaccccaggctccactggcagagagcagagaaggggaggagagaagaagcagctgaatgctggagagaagcagtttgacttcagagggatgacttgacagcaggacttcaggggaagaataccttcccggtccctcccctttccacctccccttcctgtggagagccacttccactggcaataaaatcctccacattcaccgcccttcaattcgttcatgcaacctgatttttcctggacaccaaacgagatctcaggtgccatgggtgaggatgctaaaggctgtcacactgaccctctgcccttgcaaaaaggcagagggttcactgagttgttaaacacttaatccaaccatggatagcaaagctaaaaaagtgcactgtaacatatgtcctgtggggctgcaggggtcatgggtactccaccctagatgctgctgtggggcctgcacagagttttggtcctgccggtgcccaaaagcatttgctctggctcttgcacctgctcacctgtgtgctgcccccccgcccatgaggggttgagagctgtggactgagtaagtgaggcattcctgtcaggaggactctgaaggggtcaaggaaaacctcatgtttcatgaggaggcaagaactgaggttagttcaccaccactaacatactttggtgccacgtgattttggtgccacgtgacttagatacattccctagtggtaacagaaggttctagagcacaaaatttaacagtgtatatatgagtggtatgagggcgaattatttttgttttctttttaatgatctcttaaattttccagaatgtctacaatgaccttgtattacttttctaatcagaaaaaaagaaaaaagttaccgaagaagagataagtgaagcacacacaaaaggcagaatatatagtgcatcaagaatgtgtgttttataatctgacagacctagttagaccatagtccatatttcaaatataattacatgtgctcatagctgagaaccttctcctgggatggatgcatttcaccaggtcactgctgaaatgttgtacttttatggatggtgatgaggaagcatctgttttaggtgtggtatttcctggaggcagaaaactgcttgagttagctcattcagtttttcagtggcctttctaatgcatgttttgttttgttttaatgctttgcaaaagattcctagagtggaaattgcctttgcaaaaattataacagtgagaaaattatgacagtgaaagggatctgccctaactgtccccatcttgcttctgggtatctttgctcattcctgggtgtgggccaagctaactttgggagaaatttagttaaattataatggcccttcccagatactaaattgcccttgtaaaactaatgaaaggccaccaagttaggaggatgagaggggcctgaattctgttaggaagtatgcctagccagccattacttaggaggaataaagatttgcaacttccccaattactccagcagataacatcactattttagaatctaagactggcctttggagatgtcttttcaggtttttgcatttctgacaaccggatgggccccacccaggaactgactcaacacaagaagacagtttccactccctatgatttcatctccaacccaaccaaccagcattccttactccctggctccctactcaccaagctatctttgaaaaaccactaacctctgagccttcagtgagactgatttgagtgataataaaactccagcctcctgtacagccagctctgcatgaattaaactttttctctgttgcaactcccctgtctggataattcagctctgtctgagcagtggttcaaggagaacccgctgggtggttagaatcagcttcactttcaaagggcctacaatgtcctcattaatttcttccccttcaaagatgactgtgatcacatgttttcaatatcgtccttccacccttggcccatgataagggcagagggtggtagatgcagtcactactgaatttcattatcccagtgggcatttttggcctgctcaactggactgactgcagagcaagtgttccaccttgaccttgattttgccatttgcatatggaaaccttttttttttttttcctttctaaattcaactctttggtaatcccagtgaaagaaatgggtgtgtgggcaactggaaggaagtgggtgtgtcctaggttgtaggattgctgagatgtagaaatgcttatgctagaaaggtatgagaacagttggtctggtcttgctgttagtagagacagatagaacaagacaaggtgggaacaacatggagtgggcagatgtttgtggtgaagtcctggcatctattgtctgagggtcccctatcaacatcacctccaaccaacaattattgaatattaaccagcatcccctgcatttataggatgaattgttaaagcaccatccaataaagtacattactgctgctactcaccctagagcacatagaattctcctggagagaaatagattgaccaaaaatcggggcctgcaatttggagcatcttcctttgtgacagttgatttgggactcacatttaaggcgcatttgtttctccattcacagaaaatttatattaatattcatcaggcttttattgtatcttgttctggaaatctgctctggaaaataactatgacccctggtcttctgccctgtcattttctctctaatttttggctttgaaaatttatctgtctatctgtctatctatctatctatctatctatctatctatctatctatctatctatctttattcttgatggtactttaaaaaagtaactcatgcctctagtttaaaataaactatgctgggcatggtggctcacacctgtaatcccagagctttgggaggctgaggagggaggattgtttgaggccaggagtttgagatcagcctgggcaacatggcgaaagtccacctctacaaaaaaatttaaaaaattagccaggtgtggtggcacatgcctgtggtcccagctgcttaggaggctgaggcaggagtatcacttgagcccagatggctgaggttacagtgagctgtgattggaccattgcactccagcctgggtcacagagagagactctgtctcaaaaaaaaaaaaaaaaaaaaaaaaaaagtcaaatagtacaaaggttactaagtgtgtctatcttcttgaggtgcctccctggtcccccagtgtgaaagctgtgtataccacagatccaaatcaagctgtcccaaatacccttcagacttggtgatgatcttctagtcattttacttgaacatggaacagccaaatagacagaaacccaatttcatttatgtgttttagtaggtgagagatgttccttttagacctggggagacagaaagaatcttaagaccttggcactgtcaccagccagttacactccagttaaggagacttgacgaagcatgaaagttaaatagtgccaaagacaaaaatatggcaaggtggggttgattagtcaccaaaggaatttacatcaaaggcattaccatgtttgttatgtaggtgccaataataatgaaatgccactctacggtatttgggaggccagaaaatttaacaaaaaggaaagtggcatcctcagtcttattggaggcagcaaagcaaacagacactggagatgaatggtcttgggtttgggtcccagctctgttctactagctgaatgatcttgggcaaagtacctcaattctctgagcctcattttccttataagatgggactactgataatatctacctcagagaactgatagaaggattaagttacatttggcatagaagatggatcaatatatggtaactcttattaaaattaaataatataaaaaagaatgtgtttggttgccaagggagtctagtcttccaatgtagcaataataagtgtataacacagcaaaatttcatctttattagattgcttgtttaagtagattttttttttttgagacggagtctctctgtgtagcccaggctggagtgcagtggctcgatcttggctcactgcaagctccgcctcccgggttcacaccattctcctgcctcagcctcccaagtagctgggactacaggtgcccgccatcacgcccggctaatttttttgtatttttaatagagacggggtttcaccatgttagccaggatggtctcgatctcctgaccttatgatccgcccgcctcggcctcccaaagtgctgggattacaggcgtgagccaccgtgcccggcctaaatagctatttttaatatgatagaatatgtcctgagcacgtactttgtgctaggtgctctgccccagtagaaggaacactgcccccaccagtaatgtgctcacagtattctagggggcaaaagaaaaaaaagctaagaggcaatgacatggcagtgtgacacgccttgcaatgacaatcacagcaagggtgctttagatgcacacacatcttcggggtggcggtgagggaaggttttccagaatagatgatgtctaagctgagatctaccaaatggggggttgacctcagcaaccacagtagtagactttttgggtgtgcttcctgtggaccagttactgtggtgtgtgtttcatgtgagttttctcatctcgtactcacaacaaagctatgaggtggaaattattctgcccactttactggtgaggagactgaggcttagagatgtaaagctaactttccatgaaaaatgtagctagtagatggagaatctgggattgaaacacatcacgtgtttgagtccatcagtaccatctgtcttgtaagaccatcctatataaaatttataaagtgacagcaaatcaggttagcagaaaagacattacccttagctaggccatctataggaagccagtgggagaaatggttttctaagatgtgggtatgcatgaaataggaagtgtagatagcgcttggggaggagagtgatgtgattccagggggttgtgaaaatgaggcatccagacatgaggatcaggtaggggagaggctgggcgaaggagacccaggaaagagagcaacagtaactaaggtgtggacagatgaaggctggtactcatgcttcttcccactgcaagaagaggagccatgtgtcatttcctctctgtgactgtgagcagcccttggcccctggaactccccaggtacaaccggaacaacatcatggtgcactgggcttacttttaagcctagaacatgaagagagctggttagaaggggacaagcaaaggactggaaggattaggcacacacattccaccatgtgcttggtgccatagagcagtttgagtctagacaaattgacagtcactgcctaacattctccatttctgttgtccagctggataatcaaagttccataacagattctttttggttttaatcatgagttgtgtgggggacaccaatggggctaagaattaattgtccatatatcattttttgaattgagccttttattctaaaacaagcaagaagcattggacctgtcagtttctgaggcagaaacttcctctcagaatggtgtgtgggcattcatgggatagtccttgaacactgtccttgtcctaataaaagcagcttacttttatttagagtgcttgtttcttgacagattttacttaagagctttatagttagtccttttaacaacccttttccaagcaaagacatggctggtagaggcagaatgagtaacttgcccaatgtctgccagcaaggaggtggcagagctgggattcttgatcgcaaacaccgcccttgactgtctctgcctgtggctagtgatgcaattgtcccacgtgtctatctgatgggctgtttgccagaaaagccttctgaaatgctttgggctgcacagggccccagttaaaatgtgtgtatgatttaaactgacacttgttaaccttgcggttatttattgagtgacaattacatatcaggcacccagctaaattctgtgaatgtagtaagcagatcagacctggactctgtcctcatagagctaaatagatatgtgcagaggacaaaatgctatgaaggaaatgaatgggtggtgagacagagaatcacaggggagggctctctgatgaggtggcatttaagttgggacctacaggtgaaccaggatgagaatcagtaagaagcccctacaatgggagagggcttggcgggttggaggaatggaaaggaggttggtgtgacttaagcgcagaggaaagggagagatgcccagggagtctgaggcaggtgctggccgaggcacatggctgcacaggccccatgtagtaggcacatttagcactgaaaatatgtaaaagtctctgagatgaaacaaccacgataaccaaaaccaagacccaggtatgctttgtcataggatcaggtaccaatgaagttcttgggagctgtgaaacatggctgacttgaccagaccagaagtttccaaatcttccttggtcgcagaacgcttagtgcttcagtaattttttcatggcatctgtaggccaaaagaaataccaaatagattcattgattaactagttagggtcaaatcgcttaaaagtctttatgtgctaaaaactttgtattggccatttgaaaaaaaatgatacattgaaacaaaaaaaatatttttttgtattctgaaatcatcacaattacttactcatgggatgtgtggcctgctgggcactgtgcaactccttaaactttggaatcagagtggacactgccaccttcatttcctgttccacactgatttccttgtggcacttgctttttgtcacagtaactgccaaaaacatggcttccccaaaagatgccatcactgaaaggaatatgacgtaatctaatgttgaaaccatgaacaaccctgagtttgtgcagtgttcaacagatatggaggatcctgtctttcccttggaaaatttaaaatacctcccaacagtcctgtgaattt

SEQ ID NO: 18 - DNA, 197609 bp, Homo sapiens
atctggttagtgttgttcattaaatgtccgttaagtactttggtaactgcagatgaaagaccctgtagggggacaaacacttgttattaacaaccatatgctgtcaagtgtgggcttataacacgggaccatatgctccaaaggttggcaaagaatgacagaagccacccaccattcctccaggccaggagcagagtggcatagggctccaggggacactgaaaatcaggaatgtaaacaaacacccctattataattaccctgccattgcaaggaagcctgaatgtgcacacttggatttttgggatagcaggaaattggactgcattccctctgatcccaccatctcctccttccatgggaagcaccaaggggaatttgcaggccctgcccattctttagcccaaagttggcaccctctcttctctgatgagtcttcctggatggtgctgggttacacagatccttctttttcattctcaccccaggctaccatatatcctgaacattttagcgtgtaatgatagtgaagttaacttttcatcctgccttataagcagtgttaggagtgggcactgtttgggagacacaatgcaaggctttttgaaacttcccaaccctgagggctagcacatgtccatatatacggcaaactctcaataaatactagagctggacctaagagctgagatgtccatggctgtaccaggttagagttttatttcatgattcttgggataccagtagagtcgattccaggatagagggtggaataagtgagagcttccacccctaaaaaaggcacaatgcagttcagtgcccttgcaaaggatccttccttgtcagattacagggacatcccctgagctcaggaagacactgactttggaaatactataaggggaaagagcaactctgcaaaatttggaatgggatcacttcaagaaagggcaatgcttaaatgataggggaaaaaatgcacccctggtagacttgcaagcagagtactcaaatcagctgagaatgcccaaaatatgattacaaagaagagtttttattagttcagcctcagaatgcaaaaataaataaataaataaacaaacaggaaacaaatgtaatcactttacagagcgcacatacattacttaaaagtagcaccttcatggagccatattttctggtcataattgtgtatcaggttcattcatgctaatgagaaagggattccagattttctttgcatctgtctgcttctcacagggctgttaagaagccacctgccattctgacaatttcatgtccttagccataactacttgtcctctctcttgaatcttaagatctttttgccttccagacacttacggtgtttctgtgtcatcctcctgtgtcttttagagaggtgggggtgaggactgccatggaagctaaagctgaattttaatttcaatcatttttttttttgagacagggtctcattctgtcacctaggctggtatgcagtggcacaatcacggctcaccatagccttgacctcctgggctcaagagatcctcctgcctcatcctcctgaacagctgggaccacaagcatgagccaccacgcctggctaattttaaattttttttgtagagacggggtcttgttatgtttcccaggctggtcaatcatttttttctagcccttttaaaattcaggcatccaaagattaaacttgcttagaagtgtaagtggccctaaattgctttatcaacaccatctccaggaagtcttcacagacatgggaactagcatcttgttctcctggatcttctcaacaggtttgcattgtcaggtttccatgtaagtatctcttgcgttcccatccatcacaagtgtatgatggcactggtatcagaacactgcattcttcctgattgtcataaaactgatgtacttgcagccttgcttgaaaagttgtcagtacaaataaaattaaattcacattttgcataatagggactgatcctgatggatcaggtcataagagtatgaaacattccatacatcctggcagacaaacgttaaataacagtaatatactaataaatacataaattacttaaatatttaaatagcatgaaggcccatggcaacttgagagctggaaaatctatacataaattagctgattgtttcaatgagcatttagcatctaactatacaaatacagcaaagatatcattgtgatcctaaaaaaacgttttaaagcaaatcagatagaaattatctttttgggtctattccgttgtgtctttaaacattttgcttaatatcttccacttttcctccaaattttcatcctggatcagaacctggaagagaatgccaaaagttgatgtggggtgacattgtaacagcaatgtctcttcttatttctcacaacatatgatcctgggcaactgggtttcagggatttcatgccagaaggcccaggccttccttatgtggcctggaatttggctggcaccatgcttgccagaggctttcttgagggttttcttaaaataatatctgattgtgttacttccttgctgaaaacccttcagtgggtttcagggcccggggcccccagaacaagattctgagtcctgcaagcttgcaagtcctccatgctctgcctcctggctacctctctcttttctttgcctttctctttaggaggccagaaccccggtctgttttctttcctgcaatatccctgtggccagcacagtgtcctacataacaaaggcaccaaataaatatctgttagtgaataaatgtatgtttctgattctggcaactgggtgctggccactccatccccctttcctctccaacacagcccccaatcatatccctgcatccaggtgcactgagagtgcaggcctgggctggcctttgagggcctgctcacctaactgcagggcacagatgcccattcgctccaagatgagctatagtagcggtcctgggcccgcacgctaatgctggcatttttgcggcagatgaccgtggctgaggtcttgtccgtgaagactctatctttctgcaaaagagaaggaaagctgtgaagaccccttggcaacatagtcacagggtaagctgagcctgtttctgcaatgcatactctcccaaaacaagcccatcttggtcttagggcactgtgcttgcaattcacaggggtgtgcatagaacttgcaccacctactggcagacactccacatgtaggtgcagcttttgtactttgtaagcccttgagggagaaatcgtttggcccagctttcatctttctagcacaattgccttgcctcaagaccccatggccactcacccagtcctgagctgatggtgagagagagacagatttgctctagccatccctgagatattgagaaataccatatcctgatcatttcatcagaaaacttgccttcaaattctggcactgctacttaatagctgtgtaacttcaggaaaatgtcttaggttctctgtgtctgtttcctcacttataaatagggataacaataatgcctacttcatagaattatagttcaaggtaaaaatcacgtcaaactcttagcaagtctttagcacataggaagcactcaatatcacctattagtcatacagatcttaaatagggaaagtacttgccaagatgtaaaataatatttaggtaaatatctattccaggatagcctccctacctaattattttcccagagagtaactagctcactgaatttctaccacatgctaaatgctatgctgaattagggctttgtccagtgattttaaaagtggggtgaaaggagtctggggcggtacaaaagggcctctggaaccttgcaacaggcaaaggaattctgctgtaaggtgaggaagctgggaagccaatatcttagcctctataagtgtagacattctgtttagtaaaataattttataatatctggaacagccaggagctatccattttgggggcgatatctcttgcctgttctatcattcattacatgcactcagttgaaacaacaattttaggcttctggagcccaggtctcctctatcaggactaattctgagtgccaagatcaatgaccaacatcagaggtagtggagtggttaggtgcatggcctttctgtctggcagattgagtttatgtcttggttatgtcatttcctagctgggtgaccttggtaaagtcacttaacctctctgagtcttcaatcacttgtgaaatgatgataatactactggctaccaaccatccttttcttggggttgggctactgtccaatgagcacgtagtgagggcagtgctgctaacacctacacaaaattcctgcatcagctacagctttactttaccttgccacagtttctggaaaaaaggaaagcctcttttccacaaaaaagggggtaaaaaaacaagaataacatcagctacctttgttgcgttaattttgtagattaagtgaaataaacatggaaaacccttggcacagctctagacacatagaaaagtgctaagaaaagtaattatgcatcacataataacatttcagtcaaagaaggatcacatatatgaccagtggtcctatattgttataatattgtatttttgctatatcttttctgtttagatatacaaaccattgtgttgtaattgcctacagtattcagtacaggaacatgctgtacaggtttgcagcctaggagcaataggctataccataaagcctagaagcgtagtaggctataccatctaggtttgtgtgggtacaccatatatgtttgcacaatgatatagctgcctaaagatgaatttctcagaatgtatccctgttgttaagtgatacatggatgtcattgttattatcatcattcatcttctcactttatggtgggcctccgtaaaactgaccaaggaatatactgcacctgaatcacttcttaccttttctctcttgctcttgccctggacctgaacgcagaatgtcagggagaagtaggaatgtggagtactccaggtgtcagggtactcccagctgacctccacctgccgagaattctttaatggcttcagctgcaagttcttgggtgggtcaggtttgactgtggaagaggataaacatgctttattttcctaataaggctttggagttcagtggttttggcttatgatctcacttgcacctttgatcagctgtgagtccactggatagttacttaacttctgtgagcacctggctggcaaatgtgaggcacctctgccgcaggtgctcacgctggtgcctcgggaaggcagtcattatcaatggccacatctcagatccacatgtattgcaggatctgagagatgctcagaatcctcatcactgaacaatcagatgggaccgcacagtgagaagacctctgctttaatggttatgggccatgcattgaaggaccaccctgtctgtgctaatccctcactttgcactgaacatggaactaagctgagcctctccctggggatgagatgatagattttctatttactgccctttcttttgtcttttcatagcttttggtgcggacatgtcttggagcagttacagtcaattgtctctatgctcaatttgcttgtttattccatgaatactgagcgcccattatgttccagccactggactgtgcatgaaggatacagcagtgagtttcacaaagactccttcctcaattaggtcttctagataagaggaggcagagacatgctagggtgtgtggttgggctctgtaggcctggcactgctccacacaaagatcacggctcctagcaggtgcttcgcacatatgcttccctctgctcttaacacaactgacatctttccttttggtgtcagctaaatgtcacctcctcagagaggccttccttggccaccctatgtgaactagaccccacccaccaagtacaaaccctccataagttttgaagcaagttctctggttctattacactttatcatgctgcctggtcaatgaataaatagtaaaggaaatgacttatggtgaaatccctatctgccaattaaaaaaaaagatgtccattttggaagggtttatattctaagaaagaagtcccttttcaaatgctaaggaaggattggttgggaataattgccattagtaaggaagccctggttctgaatatgaatattatgcttgattaggctctgggattcatcatggaaactatctggcagctgaatcaaagtgcagtaaagagcagctgtagtggagtggatctggatttgaacggctagctgtaagatctgagatctggggcaagttgcttaacttttctaagactcaatttcctcttccttaaaatgcagataacagtatctacatcgtattttgtttttggatgcagaataaaagagatgatgcttgtcaaccacctaccccacagtgcatggggcattgtgaacacgtgacaaatagtatctttccttatggagcacatataatcatccaaaactcactgatgtccctgatgaagaagctgctggtgtagttttcatacttgagcttgtgaacggcatccaccatgacctcaatgggcagactctcctcagcagctgggcaggcactgtcctcctggcactccactgagtactcatactccttgttgtcccctctgactctctctgcagagagtgtagcagctccgcacgtcaccccttgggggtcagaagagctgaagtcaaagacagaaattagcctgtgttacacattggggagagagttcctagtgattgtagccagtaaggcaggtaaggcctcaactgttgtctgaggacacagtttctccaactgggctgatttctacccagagggtaagaaactgccctccccaggagaaaaagcttaaattcaagagcacttacatgtctctggactaaatgaatatggaagtttttgtttgttttagatctagaatctctgattattaaacccccttgttaaaaacttaaattcattttttcccattttaattataaaatcaatacacaaatcagtacacactaattataaaagtaaagatgataaagatccatataaaggaaagaagtgtatgtctccttcatccttaactgctctccacaggtttaagtactaataatagcttgttgtatccttccagaccttcctttttctttttctttctctctctctctctctttttttttttaagagacagggttttgctctgccacccaggctggagtgaagtggtggaatcagaccccactgtagcctcaaactcctaggctcaagtgatcccctccctctgcctcccaagtagctgggactacaggtgtgtgccaccacacccacctaatttttttatttttaatattttctgagatggggtctcactgtgttgcctaggctggtcttgaactcctggcctcaagcaatcattctgtctcagcctcccaaagagttaggatttcaggtgtgagccactgtgcctggccagaactttttcaatgaatattcaagataattgtatacacattttatatatatatatatatatacacacacacacacacacacatatgtatacacacattatatatataatccatgttatatacatctctacattatatatatccactatatatattttacttatacatatagattttatttttatgaactaggatcaaattgtatacatatgattatgtaaccatccttttcccctctgaacatattatggggagctctccatgacaaaacatatgggttgggttatccacttcaatgactgcacattaagcaagagtatagtgtaccatgttttatttaaccattcctctgctgattatgtctttatgcacttggagaaacatttctttagtaagcattttccttttaaagatgaaaaagtgagaccccaatgcttaatttactcagtgaaataatggtaaagtcaggatgatcacctggggtttgcttcggtgatgattaaagtaagccacatgggggttaacacataggtcttgtatttatggaagttgctttcttacggaaagtccaggtgcattggaccaacagcgaacttcagattagtggtgtcagcagaagtaaaaggagttgaggtggccctgggaaaatttcgggaggcctcatcgagttttggagtctgcttcagggcccctaagatctacgccctggagctcttgtttttatttttgactcaaggtgcaatttcagcaagtcatttgtagctttgaattctccgtttatccctttctttggtgctatgaggcttcaggaagcatggccaggcaatttggatgagtgggttcaaacacagcagagactattctcagttcccaataatatcctgccccaacacatacatttattcaagcaatcggctaaaatctccatgttctttcttcaatgtagacaaggaagggcggttgaaaaaacacgggtttgactttgcttttcccattatcattaactgataggtcactgagaggttgcccttaatttcttaatgaaatagttctagaaaaatgctgagaaaccagagcagtttcactcaccctctgctgcttttgacactgaatgtcaaatcagtactgattgtcgtcagccaccagcaggtgaaacgtccagaataattcttggcctcgcatcttagaaaggtcttatttttgggttctggatttgaaaaaaacaaaaattcaatatttaggagttttttgcagaaaggttttgattgtgatgaatcacagatcaccagatggtacagggtgaagttcttccatgcgttgcctcttgggtagctccataaggattgggagtatcccagtggggtgttgattctgcagagtacactacacacctaacatgcctggcagaggcattcattttttgaaggctatcaccccagtgcagagtgatacactatcggttaatttccattagccattaaataatatcaccattatttaaagaaaacatgaggctaagcattcagactgatcatgaaactcccttaatatgagattttgatggttgataacccaaagggtccaggaaagcaaaggaaaatggaggttaacatcaattaacatcaataagagacttgatgttaattcattacactcaccatgacttggcttttcaatttgttgttgttgttgtttttaactcttatgagcgaaagagaaaattgatactatccaagggtatagaattacctttctggtcctttaaaatatcagtggaccaaattccatcttcctttttgtgaagcagcaggagcgaatggcttagaacctcgcctcctttgtgacaggtgtactggccagcatctccaaactctttgacttggatggtcagggttttgccagagcctaagacctcactgctctggtccaaggtccaggtgataccatcttcttcaggggtgtcacaggtgaggaccaccatttctccaggggcatccggataccaatccaattctacgacataaactggaatgcacataaagtggagaaccaggctgtaagctccaggaactctgggactgtgttttattaacccttcgggcatccccattgcctaaacacaaccttgtttacaacaagtatttggcaaatgcttgctgagatgatctcaaggcatgagaccctgcttgggctcaaggtcatggaaaagagaaacaaagagttttatagctgccatcgactcattgactggaaggctgcctttaatagtaacctttgattatttagcagattggaaacaccttaatataccaaaaactgcaaacagcacaagactctttgccaaaggtctgggggagagaaacttccagcacaatttcagtttcatagagaatacggcagggcacaatattcagcagagtaacatagtggttaaaagctcagggtgtcgagaacaacgaaccaagactgtcatcctgtctccactaaccagctgggggatttggaacaaggtatttcattatcatgagcctcagtttcctcatctgtaaaatgataataataacagtatctgccttacatttgactgaggattaaatgaaaaaaaaaaaaagcacgtaaagtacttagcacagtgtctgccacacagtaaattcggtgttagttatcgttacttatagactgaggagtcagccaactgtacagagaaactctcttaacaattttccatggatatttaaggatttcgttccctctgttttaaatcaccagtggagattttcattctctctgcattattattattattattattatttttagctatcttacactcttatgaagcagtccagtagagcttagtcttcccatttaatgaagaagcgtactgaggccaacgatctaagcatggtcacagcaagtcagaagtacaagggctacagctcagaccttttgtctcttgggctttgcaagggatgcctaatgctagtgtctaaactggcctttgaggaatggcttagtatagtatttcagagtgtgtcatagcaaagcttcattcatttttttaatccatgcataaattattaattgaatagaattgtttaatgtagtagttcccaaagcatgatcgatgaaacaccatcagcagcatcaccttggaatagatcagaaatgcaaattctcagctgctgaatcagaaaccttgggatggatttagttatatggttcttaagctctccagatggtgctgatgcctgctcaagtttatgagtcacagtggttgagagcctgcattttggagtggcagaggcctggatttagaagcagctctagcccttgctccagtcttgtggcctttggcaagacattcaactactgtaagcctcagtgtcatcatctttaaaatgagaaaaatattagcccttgctttagaaggtggatatgtggattatataagctcatacacagtgcccttacatgctttataaatggtggttctcgttattggcctctggatgtaaagcattgtagaatataaagttttcactttacatcaattggattataaggactgaatggataacaaaaataagaggtcaaaagcatttggggtccaactctggggaaatgattagctgtgctgatgtaaaaccatgtggcacttttggctttttcttggttttttttttgtccccctgacacctgaagagcatggttactttcctgtcccaactgaggctcggaagccctagaagatgtttgctcaacagcagggaaaacagctgcaggaggaaagctgaagaggagcatcaagaacctggcacttagcctcactgcatcgtctgccctcctaagtcacacctcggagagtttctcacactgattttctggaatttctgtggtttaccaaatcagaagtcactaaggggtcaaatatgccaggaccaaggttcctgagctcgctaacaatcccagggttggaagggatctgccatatacccctggctcaggcctttgcctttacttaagagagtgtctaaatctctcaaattctcatggagaaggggtggctggattctgtcttcctaaaattcttgagaagagaggagtggtcccagatttctttcaggtacccatttcaagatggtactttctagaatatcaaaagattatttctgatcatcagctgaaatattttcatccttaatttatgtccatttcctcttattcagctctccaaagacctgggaaaaaattacttcatgtccttgtaaaaacgttttcacaaatttaagtgcaccagctttgaagcaagacagaattgggatcaagtccctgttccacccttaccaggtatgtgacattgggcaagttacttaatctctctggcctcagtttccaacatctgtaaaatgggatacagacagtctctacttcatatggctcttgtgagaattaagtgagacagtgcactcaataaacattaactattattattatacaattaaagatagtaatcgccaacattatgatgttggcttcagtgataaaaatctgagggtctttcaggtacagccaacggtcagaatgcacatttactgagtgtgagatactagaaggatgggcagaactccttattttaccattaactattctattagtctactaataatttttactgatcattgggataataaaaagtatctcttgaatcatgaaagatattttaaacaaccaaaatagtaatactagctgacatttactttcactttactatctgtcgagttgtattctgcattcattaacccactaaataacccacgtggtaggcatccactttgtaacatccagtttacagttgaggaaattcaggattagaggtgacccagcttaaagtcacataaccagtcattgacagacctaggacttgaacccaagtcaatgtgagtctgaatcctatgcttcctccaaagtgcttggtcagaggtaagtcatcacagtgccaactgagggggcagtatcatgtggtggaatgagaaacgaacacagttgttatactttgcaaatcctctactttggaattttaattgtgtgaaacagtttttagtaatattggaaaatatcatatgtcatatgtctttccccaccatatcatatatcatatgtctttccccaccatagtgtaccaatgtcatccaatgtgaaaaccaaacaatatagataccatcaaagtagaaaagagagatatggcattgcattttcccagagtgatggctttctctagaggacccagtgcatggttgcccatttcagtttgatttcccaccagtggctgcccaagagtcctggcttagaagtggggcctccacagagaataatgagaggctggttaccatctttcttcagttcccatatggccacgaggggagatgccagaaaaaccagggaaaaccaagagatgaccaactgctggtgacacatctataagaagggagagaagcagggggaagagaaggaggaaaagagaaggaagaggaagaaaaaagagaagaaagaatgtcaataattcttgttacctttgtgaaccatatacacattctagctactttttttttaaataaaatcttgattctcccctttcttctccatactgtcaagcaaatactaagtaaattacaggagttctatggcagtctgtggggaagaacatctctaaatagagaaccatagggtatttggggctctggagctgaaagagacctaaggcaagccatctgatacaatcctcttatttttaagatgagaaacttaaagcttagagaaggaatgtgactttctggatcaacatctagcagttgtttatttagtgcttactacataaagagcactgggctagaagcagttgagagagaaaaaaagggcttacctggatcccgcttcctaggagcaaatacttttactcaataaatatttattaagtcagtgtgttaaatgcctccccgccagctggggagatgagccatacatttgtatcactgcagcacaaagcagtgtgtgctggagcacccagaactgaaggacttgggttagggacaggaacggtaatacagaggcgaactttcaggttctggcaacgacctggtcaccagcccttgctgtaggggtttagcttctcttgttttccaagttcaaagactactctctcccatatagagaacctagtggttctaaaatttgagtgactgtcaggataacctggaagcactgctacaacagacggctgagtcccacccccagagtgtctgattcagcaggcatgagggcctgagaatatgcatttctagaaagtttccaggggaagcagatgctgctggcgctaagaccacaccttgagaaccactggtttaacccatgttcagggtccagaacccctgaaaatcaaagtgttcattgggaaaagaccacaacatattgatatatccaccatgaaatagtaaaatgcataattttatgttaaataagccaccatctgatatagaaaccagtctaggttagtatccagggtttatgaaaatcttccgattgcaaaaattacatgccacttacgaatgaggtagggatgattattgaaacattctgaaacaactccattcaccttgcagagcacccatggtctggaggaaagtggttctgaaaccactgttttaaactatatgaagggcaatgctcaactgtttcagtcaaataccttaaaaatgagcattcctgggttgggtgacggaatattgacaaattacagctttgtcagaactgctactaactctaggcggaccttgctatgtactttattcccttataaagtttgtgagtggcagagacaggcctagaagtcaagccttcttggacactgctcagtgctgtcaccacagcatggagttttaggggcatggctatcacttcagtctaggttatgactgtagcaaagtactagctggcacagggcaccggttagtacattcacaggcttgaagttaaacagacacaggcttgaattttggtcccaccgctcatttgctgttgagcagtgggagcaacttgttggccaagttactcgctgagcctcagtctctttgtctataaaatggacctaatacttatctcaaaggcttgttgggaaaggcaatgagataacatattatagaaggcaaccaataacatattaacttgaacctagaggaagaggtaagggaacaattcggtatctgtgttttatatatcatggatagtcaagaaagtcattctaggcagtagggaaatgtgcacagaggtactgcaattacatgcgcctgtaaaacccagaggctggcacactggaagggaaatagtggagattcctggcatctcctggccacttacgctgaggtattcccactagctgtgtgcccagcacttcctctgcatgcctcagatgcatttgacaatctcaggtgaactgcacttcagggtcaagggaaccccggccatggttctaagaagcaactcccattttagtatcacctacatttgaaaccacagagcactgtccaggagaggtgatggtggtgggtctcctcctttggctctctggcccatcagctgatactagggagcgctatccctcagcccacatttctcagcatggtaagtctgagagtcttgatgattaaaacacatttttgtgtgtgcaatttcataggttttctaaactcttgaaacccttgcatgaaggacaaagggaccccacgttacacactcctacttcctggagtatgctaagggcttcccaacactggtgccaacatcagcatgccaatgacgcttgggtgggcatctcttttttaagttttgtttgttacctttaattagaaaagggagttattattaaagaataaaaagatatagtcacagatggcatgggtggcacatgcaaagatccctagtttgagggccaggcagacttctagaactgtgtgactctgggtgagtcacttggcccctttaagccccacactcctgatctataaaatgggcatgctactgtggtaaggagttagtgacataattcacgtgaagtgtcatggtgcctagatgaagtcaggacccactatttgctcccctccttccacagcatttactacaatggcaacaatacagtctcttctttactgtttgtcttctctgccacactgagtgaactctcttatgccatggatcatgtctatcttgttttgcactttacccccagagtccagcacagagggattccatgacttattagtagcatgaaggaatgtacggaaatcatacaatttcagattccagtaaactaaactctaagaggttacccacattccatctagtatcttgcaattccttgtttgaaaaagtgggtcatcacctggggtttagtaatccctttgttaaaatgacattgttgttgcacacaattttacctgggcaagtaaaaaaacctttttttcccccttctcacagatttaaaaactctttaggaagcaataatagcttttcattttttaactggggccaaagttagttaatccacaagaatggggatcccagctgtcattttggttgatatcacaactgacgaccaagaccatcacaaatatgggagcaagtctgatttgtaacattattataattatgaatccaattactttaaggaatgcacgaaaggctttttaaaaatttcaatagtaaggcaggcaccactcactttagctctatacaatcctttaactgatgggcattaacatttaggaatatacttttatacatcaatacacaccacttcaaaataagataaaacaaacatttccacaaactatgcatacacacagatcttgctatacagttattattaggtggcttttaaaatggacactgtacatcggtccctagagtactaagttttcactaatgttccagcagatgactcaccagggatgcttccaggaatccaccaactccctcctgccagctgctggggtagcacactaacggtttctacacctggacagctgcaggcccacagggaggggagggaggtaggggcttgggaagtgcttaccttgctctgggcaggacggagagtccaatggccctgaaacagatgttgtttcttctgctgctgttgctggtactggaacttatatactctactcctttctgatggaaacttaaactagaaactgacttgttgcaacattgaaaacaactctcaaaaccttctgggggaatttcaagaagttccttttttgtttgtctctctctgtgtgtgtatcaataacgaggagggaacatagacatcaaaatcccaggtaatgaactaagaggaaatgacttttgggtggggaataaggaaggagatggagatgctaatttctctgggtttacatcatggccaaggtgcttggagacagcactaggcagattccctgggttccacagatcgaggaagaaggaaggccaaggggcggtcagacgggaggctgagttcatgtcgggatggaacaactgtatgcccaagggcttaaaaacaaaatcctggttcttcccaagtcagagaggatgagatgaagggcaaagggtttagtacatctggggcgccttcctccacattagtcctttaatttcagaaacatactatttaccacccatcttggctccatgcacctctccccacattccccgagtgggaacacacgcgtgcacacacacacccatgcacatttcatacagacacagacctggggagatgataaaactgcgtgtaccactaataagactcaaatatgtgcacatcctgtgctcataggtactcgctcataggggcggatgggagcagaaagtgaaataccctcagggaggcatacagacaaccacactcaaggcacccccccttgggcacccagactacatcctcatttcatttgcacacaaatctatggccctaggggctccgtgcagatgcacaggaatagcggaataaagatatctctcgtggtggaatttcaagttgctaagaggtatgcaaaggtgtacaccggtgtggacccccccatcccccgcccagtctgcacgtgaacaggaacatgtacctgcacgtataccaggtacacgcagacagatgcgggccatccccagagccgccgacagaggtcgctgcgagacggtacccgcgccccacagtccacccgctcctcggagtccccccgcgccccggagtccacccgcgccccggagtccacccgcgcaggtccacttctccatccctgctctcgacctccgcccctgcggtgggggaagttcctggggcggtggctgggaccaggccgggttttaggcgggcgcagatttccgggctaactttcctcgccgtctcagcgcgggaagggggaaatgggaaacccgggccagagcagcggagcttcccagccgcacacttcctccctccagccgtttgtctcggcaggggagggcccaggcagccaagccggcaggcccactggttatccgaccttgtgctctggccgtgggtggagaccttacatccagctcagagcgcctcctcccatcccctgtgtcctctaggcctccccagactttgccttttagccttccagtgaaacaagttctgtatccaagatatacaattaagtggacaaagcagattgcaggtatgttttttcgtatgataccatttgtggggtgtgtgtgcgtatgtgtgtaagtgcacctgcacttttcacaactggtatctctgaggcatatgtaacaactgggggaggggctttttgtaaacatgtattaatttcctccgatccatcactaaagtgtactgaacagaaattgacgtgaagtagtttcactaatttatttacagtggctgcaccaccacagatgagtccttgtgcccccccataaataaatacatgcataaaataagacaagtaaggttcaaaatgacacaaatattttattcatgtgttcgtaaaagcaccttgaaaattaaaaaaaaaaaactgtaacgtaaagtctcagtaaaaatccagcgccagttatgcaaaagaagcttcgaagtatgccctcatcctcccttttccgctcagattgcagcccgagggctagtcctatatgaaagggcccccagtgttcacctccaccagggacaagtaatagggttttaagagcatgggctctggagttagagagctggatacccgcacctgcaagttacttaccttcgttaagcctcagttcctcacatctgtaaaatcgggttaataatagtacctgatctcaggactggtgtgaagattaatgagatatgatgggatgcagttaaagcagcatcctggctaaacgtttaatgaatggctgcttgcacttatttatttttttatcctgtcgtgtcccagaaagtcttttcgtagctcacaaggggacatcaaagatgacaaagaggagtggaagaagacagagagaatcaatgtgaggagcctggaacagggctctgaattgtcttcccacagtgaaatcacttgtctattgctgagccaagaatttgactctgagcatctaggatgagaaagaagaactggcacctacgccatctctgcccctcgggactgactattttggtaagttcagttcacccatggaggaagtggttctcgtactttatctgcatgtaacaacaaaattcaggttcttggggctgatgcttggagattgtgattcagatctgggatggggctcaggaacctgcattttaacaatggaggttctaatgtggtcattggcaggttgttctaatgtgggggccacattagagcctctctcggagacaggctgtacatggccagccagcattctggtaatatgagccaaatgcccattgacctaattttggagaagaggtttatcaacatgtcccacttcacaatccagaccctgatcccaggcaaaataaactgatacctataagctttctattgcttaccctatgggcgaggaaggtctgctgacaaacagagggcgtgctgagctgcaaggttaatgtgtctgatgattaagctgtgacatggaggcaaccccctaaaaaccaaaaataacttaaagaatttttttggccacaaaaacttattttctcctagaagaatgctttgatcatctagtacacatttcaaataaaggagaagccatgtgtacttataaaaattaaaatcttagaaaattacataagcaatacatgcatgcatgctattgtaaaaacttcaaacaatacaaatatacatagaatacaatgttgaggccctgattcctgtggcttccagaggttaccagtgccagcattcctgcagagcttctgaatgcttctctatgtatttatatctatctggctatataaatggaatcatactatacatattgttctgcaagttgctcttttcttgcaacagtctattttgtattcagtcacttgcagtgacttgctagaggtcacttgaacagatttcacgtctgcatcaattaggttgccctgggcttagttttctaaggagctctgcagttccaggcatcaatccactaaggactgataacacctgggataagaaaagactatcttgtcctgttgatgtctcttaggagcaaataatttgccctacaagctccatagccttttcatgaagtctcacttatcacctgtataccactccctgacaaggagaatgggcttattacaaggaaagtgatagacaaggcaggtttgccctactagatggaaagtggtaggccattgagagtcatgaaaccaccctcacagggttgacaagaattgcatgctgggttctggacaggaatatagttataattaagcattgattaggttgcacgttggcccacttccttgttgctcaaagtcacgtagcactagatcctgaccatttgcatctgcattattcctgtagataggatttctgacattagggtcataagattgtgtaggaattgatttgtatccctattgttcctttagatgggatctctgacattacaatcagaacgcttttgtttaagaatcacttaagttgtttttcaggtccccaattctaccatatttcagtttgaaaacccccacaaagaaaggggatcaggttgaaaatacagcttcaccctgtcccatgacttcaccatgcactcttcaaccagtcaaccatctccaacacatcagcccactcccaaactcttaaaaaccctagccccaaatgccacaaggagatagatttaaggtttcttcctgtctcctcatttggtgaccctacgattaaacctctttctctgctgcaacctggcctctcggcgtattgacttgctgtgtgcaatgggcaatgaacctattatggatacagtcacatgtgtctgttacatgagtccaagtgatttgtgcggccagtgaagtgcagaaatagggcaattgtgtggataatgaaaactaaggcttcttcccccaaatggtcagttgcttttgaagggatacttctagcctaggagtatgggaagtagcttctacctcctgcctcatacatacatgctcttaccaaaagaagagtggaagtgtcacggcagatagctagtcagacatgagcagggcagaagagggttcccccgccactccccgcccaccaccactaggaatgtcaggcaaccatcaggtgagggtcagatggttattaaactgtttctctaaaataataattggtcacagctggtaccagggaaaggcagtctcccaatagatagaacacctgaagctggtgattagcagcttccggataagatcttaggagctgggcgaatgggcttaagcatgagcactaggagggaaaatggtcgaatttaactggtgtatgagcttcttctaagaacactcaactagtaagggaagaatgcctcaagtgaacatgcgtacaatttcagtaaacatactgtgtatgtggcccctcccaagtgctggcaggccaccccaagagaagaatcaggggagaagggaggcaaccccccagaagcatgccagcatatgcaaccccaaatcaaaggttaaaccatacacttgaatctctcaagtcaccctccctcttccaagtgtacttccttttgttcctgctctaaaactttctctttttttttaactttttttttgagatggaatcgtgctctgtctcccaggctggagtgcagtggcgcaatctcggctcactgcaacctccacctcctgggttcaagccattctcgtgcctcagcctcctgagtagctgagattacagctaccacgcccggctaatttttgtatttttagtagagatggggtctcaccaggttggccaggatgttctcgaactcctgacctcaagtgattcacccgcctcggcctcccaaagtgctgggattacaggcatgagccactgtgtctggcctcctgctctaaaactttttaaataaactttccctcctgctctaaaacttgcctgggtctctcactctgtcttaagccctttggtcaaattctttcttctgagtaatagggacaggagacagagaaattctaggcagaaaagagtgggggtttttggcaaagacccaccctcaagcctggtgctgtggcccaaagtgagaacatgtagtcctgttttcccactccaatgttgccgtttcccaaaccacccatggcccaccctgcccccacattctgcacccataaaaaccccaggctccactggcagagagcagagaaggggaggagagaagaagcagctgaatgctggagagaagcagtttgacttcagagggatgacttgacagcaggacttcaggggaagaataccttcccggtccctcccctttccacctccccttcctgtggagagccacttccactggcaataaaatcctccacattcaccgcccttcaattcgttcatgcaacctgatttttcctggacaccaaacgagatctcaggtgccatgggtgaggatgctaaaggctgtcacactgaccctctgcccttgcaaaaaggcagagggttcactgagttgttaaacacttaatccaaccatggatagcaaagctaaaaaagtgcactgtaacatatgtcctgtggggctgcaggggtcatgggtactccaccctagatgctgctgtggggcctgcacagagttttggtcctgccggtgcccaaaagcatttgctctggctcttgcacctgctcacctgtgtgctgcccccccgcccatgaggggttgagagctgtggactgagtaagtgaggcattcctgtcaggaggactctgaaggggtcaaggaaaacctcatgtttcatgaggaggcaagaactgaggttagttcaccaccactaacatactttggtgccacgtgattttggtgccacgtgacttagatacattccctagtggtaacagaaggttctagagcacaaaatttaacagtgtatatatgagtggtatgagggcgaattatttttgttttctttttaatgatctcttaaattttccagaatgtctacaatgaccttgtattacttttctaatcagaaaaaaagaaaaaagttaccgaagaagagataagtgaagcacacacaaaaggcagaatatatagtgcatcaagaatgtgtgttttataatctgacagacctagttagaccatagtccatatttcaaatataattacatgtgctcatagctgagaaccttctcctgggatggatgcatttcaccaggtcactgctgaaatgttgtacttttatggatggtgatgaggaagcatctgttttaggtgtggtatttcctggaggcagaaaactgcttgagttagctcattcagtttttcagtggcctttctaatgcatgttttgttttgttttaatgctttgcaaaagattcctagagtggaaattgcctttgcaaaaattataacagtgagaaaattatgacagtgaaagggatctgccctaactgtccccatcttgcttctgggtatctttgctcattcctgggtgtgggccaagctaactttgggagaaatttagttaaattataatggcccttcccagatactaaattgcccttgtaaaactaatgaaaggccaccaagttaggaggatgagaggggcctgaattctgttaggaagtatgcctagccagccattacttaggaggaataaagatttgcaacttccccaattactccagcagataacatcactattttagaatctaagactggcctttggagatgtcttttcaggtttttgcatttctgacaaccggatgggccccacccaggaactgactcaacacaagaagacagtttccactccctatgatttcatctccaacccaaccaaccagcattccttactccctggctccctactcaccaagctatctttgaaaaaccactaacctctgagccttcagtgagactgatttgagtgataataaaactccagcctcctgtacagccagctctgcatgaattaaactttttctctgttgcaactcccctgtctggataattcagctctgtctgagcagtggttcaaggagaacccgctgggtggttagaatcagcttcactttcaaagggcctacaatgtcctcattaatttcttccccttcaaagatgactgtgatcacatgttttcaatatcgtccttccacccttggcccatgataagggcagagggtggtagatgcagtcactactgaatttcattatcccagtgggcatttttggcctgctcaactggactgactgcagagcaagtgttccaccttgaccttgattttgccatttgcatatggaaaccttttttttttttttcctttctaaattcaactctttggtaatcccagtgaaagaaatgggtgtgtgggcaactggaaggaagtgggtgtgtcctaggttgtaggattgctgagatgtagaaatgcttatgctagaaaggtatgagaacagttggtctggtcttgctgttagtagagacagatagaacaagacaaggtgggaacaacatggagtgggcagatgtttgtggtgaagtcctggcatctattgtctgagggtcccctatcaacatcacctccaaccaacaattattgaatattaaccagcatcccctgcatttataggatgaattgttaaagcaccatccaataaagtacattactgctgctactcaccctagagcacatagaattctcctggagagaaatagattgaccaaaaatcggggcctgcaatttggagcatcttcctttgtgacagttgatttgggactcacatttaaggcgcatttgtttctccattcacagaaaatttatattaatattcatcaggcttttattgtatcttgttctggaaatctgctctggaaaataactatgacccctggtcttctgccctgtcattttctctctaatttttggctttgaaaatttatctgtctatctgtctatctatctatctatctatctatctatctatctatctatctatctatctttattcttgatggtactttaaaaaagtaactcatgcctctagtttaaaataaactatgctgggcatggtggctcacacctgtaatcccagagctttgggaggctgaggagggaggattgtttgaggccaggagtttgagatcagcctgggcaacatggcgaaagtccacctctacaaaaaaatttaaaaaattagccaggtgtggtggcacatgcctgtggtcccagctgcttaggaggctgaggcaggagtatcacttgagcccagatggctgaggttacagtgagctgtgattggaccattgcactccagcctgggtcacagagagagactctgtctcaaaaaaaaaaaaaaaaaaaaaaaaaaagtcaaatagtacaaaggttactaagtgtgtctatcttcttgaggtgcctccctggtcccccagtgtgaaagctgtgtataccacagatccaaatcaagctgtcccaaatacccttcagacttggtgatgatcttctagtcattttacttgaacatggaacagccaaatagacagaaacccaatttcatttatgtgttttagtaggtgagagatgttccttttagacctggggagacagaaagaatcttaagaccttggcactgtcaccagccagttacactccagttaaggagacttgacgaagcatgaaagttaaatagtgccaaagacaaaaatatggcaaggtggggttgattagtcaccaaaggaatttacatcaaaggcattaccatgtttgttatgtaggtgccaataataatgaaatgccactctacggtatttgggaggccagaaaatttaacaaaaaggaaagtggcatcctcagtcttattggaggcagcaaagcaaacagacactggagatgaatggtcttgggtttgggtcccagctctgttctactagctgaatgatcttgggcaaagtacctcaattctctgagcctcattttccttataagatgggactactgataatatctacctcagagaactgatagaaggattaagttacatttggcatagaagatggatcaatatatggtaactcttattaaaattaaataatataaaaaagaatgtgtttggttgccaagggagtctagtcttccaatgtagcaataataagtgtataacacagcaaaatttcatctttattagattgcttgtttaagtagattttttttttttgagacggagtctctctgtgtagcccaggctggagtgcagtggctcgatcttggctcactgcaagctccgcctcccgggttcacaccattctcctgcctcagcctcccaagtagctgggactacaggtgcccgccatcacgcccggctaatttttttgtatttttaatagagacggggtttcaccatgttagccaggatggtctcgatctcctgaccttatgatccgcccgcctcggcctcccaaagtgctgggattacaggcgtgagccaccgtgcccggcctaaatagctatttttaatatgatagaatatgtcctgagcacgtactttgtgctaggtgctctgccccagtagaaggaacactgcccccaccagtaatgtgctcacagtattctagggggcaaaagaaaaaaaagctaagaggcaatgacatggcagtgtgacacgccttgcaatgacaatcacagcaagggtgctttagatgcacacacatcttcggggtggcggtgagggaaggttttccagaatagatgatgtctaagctgagatctaccaaatggggggttgacctcagcaaccacagtagtagactttttgggtgtgcttcctgtggaccagttactgtggtgtgtgtttcatgtgagttttctcatctcgtactcacaacaaagctatgaggtggaaattattctgcccactttactggtgaggagactgaggcttagagatgtaaagctaactttccatgaaaaatgtagctagtagatggagaatctgggattgaaacacatcacgtgtttgagtccatcagtaccatctgtcttgtaagaccatcctatataaaatttataaagtgacagcaaatcaggttagcagaaaagacattacccttagctaggccatctataggaagccagtgggagaaatggttttctaagatgtgggtatgcatgaaataggaagtgtagatagcgcttggggaggagagtgatgtgattccagggggttgtgaaaatgaggcatccagacatgaggatcaggtaggggagaggctgggcgaaggagacccaggaaagagagcaacagtaactaaggtgtggacagatgaaggctggtactcatgcttcttcccactgcaagaagaggagccatgtgtcatttcctctctgtgactgtgagcagcccttggcccctggaactccccaggtacaaccggaacaacatcatggtgcactgggcttacttttaagcctagaacatgaagagagctggttagaaggggacaagcaaaggactggaaggattaggcacacacattccaccatgtgcttggtgccatagagcagtttgagtctagacaaattgacagtcactgcctaacattctccatttctgttgtccagctggataatcaaagttccataacagattctttttggttttaatcatgagttgtgtgggggacaccaatggggctaagaattaattgtccatatatcattttttgaattgagccttttattctaaaacaagcaagaagcattggacctgtcagtttctgaggcagaaacttcctctcagaatggtgtgtgggcattcatgggatagtccttgaacactgtccttgtcctaataaaagcagcttacttttatttagagtgcttgtttcttgacagattttacttaagagctttatagttagtccttttaacaacccttttccaagcaaagacatggctggtagaggcagaatgagtaacttgcccaatgtctgccagcaaggaggtggcagagctgggattcttgatcgcaaacaccgcccttgactgtctctgcctgtggctagtgatgcaattgtcccacgtgtctatctgatgggctgtttgccagaaaagccttctgaaatgctttgggctgcacagggccccagttaaaatgtgtgtatgatttaaactgacacttgttaaccttgcggttatttattgagtgacaattacatatcaggcacccagctaaattctgtgaatgtagtaagcagatcagacctggactctgtcctcatagagctaaatagatatgtgcagaggacaaaatgctatgaaggaaatgaatgggtggtgagacagagaatcacaggggagggctctctgatgaggtggcatttaagttgggacctacaggtgaaccaggatgagaatcagtaagaagcccctacaatgggagagggcttggcgggttggaggaatggaaaggaggttggtgtgacttaagcgcagaggaaagggagagatgcccagggagtctgaggcaggtgctggccgaggcacatggctgcacaggccccatgtagtaggcacatttagcactgaaaatatgtaaaagtctctgagatgaaacaaccacgataaccaaaaccaagacccaggtatgctttgtcataggatcaggtaccaatgaagttcttgggagctgtgaaacatggctgacttgaccagaccagaagtttccaaatcttccttggtcgcagaacgcttagtgcttcagtaattttttcatggcatctgtaggccaaaagaaataccaaatagattcattgattaactagttagggtcaaatcgcttaaaagtctttatgtgctaaaaactttgtattggccatttgaaaaaaaatgatacattgaaacaaaaaaaatatttttttgtattctgaaatcatcacaattacttactcatgggatgtgtggcctgctgggcactgtgcaactccttaaactttggaatcagagtggacactgccaccttcatttcctgttccacactgatttccttgtggcacttgctttttgtcacagtaactgccaaaaacatggcttccccaaaagatgccatcactgaaaggaatatgacgtaatctaatgttgaaaccatgaacaaccctgagtttgtgcagtgttcaacagatatggaggatcctgtctttcccttggaaaatttaaaatacctcccaacagtcctgtgaatttactatgctaccccagggtgacctggtagagagtttggaaccacagctagccatagtactttcaaactactaaagttagatatctctttgccaccaaatccctcctcagggccatatgtgaccctgcattttgtgcagggattccaggaagcaaagttgtcactctttctggaaactgtatcctatttgcccaaccatcaataggggtacctctggagtgcgaacccagcctggcttatttgaatagaggaaaggaggaaaggggtgagtaacatgtacagatggtcagcagtagtatgaaagcatgtgaggttgaaccaagaggaaatgagtaggtgatacacaaccataattttggggcccttgatgaagaaatgagtgctgaaattctgaagggtttgttattgtgcagacctgcagttaagctggctaagctttaggtgttgcctctgcagtcaggaacatcctgccagaaggcaattaaagagtggaagagcagaaatgcagagaaggaattcaacacctgctccaccagcacgttccttggtcgctctcgtctgtttccctagctggatcacattcttggtgaatgagagaaagtatgaggattaatgagcagacctgtctttgggataccctagaaccatgatgcaatgcaaatatcacagtatctcaaaggacagtagccagtagagccagttgacttcaagtcagtttaactttctctttctgcataaagtcatgtatgcaaatcatctaggatggctgagatgctgatgaaatgagttcccatggcaactggaagattatccttacatcatctttgtgatgagcaaagttcagtgaagaccagagggaagtaaaattcttgcttgtcactgaacttggactgtttactcaacctctattgcttggttttctcatctataagatgagaataatactgagatgggattgttcccttgacctcctcatgggacttgcaacattggtgacttgtttacttggccactgcactcaaaccccttgcatgagggggagcacacaggagagcaggagcaggagctggggtgattgcctttggaagccattaggaacaaactgtgtaccagcctgtggcagtgtctaggggttgtccatgacctctggagcccaagggggcatgtgttacaaacaatactcttttagcatttgctgtccacagacagctaagtgtttacccgctcagtggagggttggggtgacagcctttcacaccctgccctcttgatacccaggttcttgtcctatgtccaggaagaatcaggtcacagggacttgaaggatggtgaatgtggagactttattgagtggtggaggtggctctcagtgggatggggagctagaaaggggatggagtgggaagatactcttcctctggagttcagccattcctggccaaattcctctccaaccatagtctccgatgtccagctgcctcttctactcttgatgttcagacacttcttcccttctctccttctctgctgcaccgctctgctcctctgccagtggaacttggagtttttgtgggtacagggtggggagggaagtgtggcatgccagggtggttttagaaaaggcaacattcgagcgggaaaacagggatgtgaagttctcatctagggctgcgggtccaggcttgagggtggagtccttgccatggaccctgccctcttctacccagtatttcccttcctcctgtccttatcagtacaaacccagacctttaagttgttacaagaagtaatgatactcactaagccaaaaccatagtgtcaggtactatgctgatgctttatatacactagcttattttatacctaaaacaatcttacaaggaagacatattataatccccattgatatctgagaaaaatgaggcacagagagaacaagtaagttgatatcaaaaatggcagggcagggataataagatacatctagtataagatttggttgagattatgagtatgagatcttagcccattgcctgcccacagcagtactcagcaaatgctaggctattattattactgttattttttgttaattccattactgttattatttgaccaggggaatcatcttaggctttatggaggagttgacattttcaatcagctttgagggtgggtaggctttggacagacagggatggggcagaagaacattctggactatgggcacaacaagagctaaggctaggaggtgggactgtgtaactttgagatggagaatagggaggagacctcaaagcagaaccttaggctctaagggaaacaagacagaaggattctgctgacaagacagtaaagtagcctgctcatctggtggtaggcactgtgtcagcgttctaggttgtaaatgtaggaagtaagcagatcagaggtttgctcaacaacctgcctagtgagccaaactgcttgctcttgaggccatgtagtccttctggggcagctcttcaaaccctagtccacagaggcaggtacccagttctttcagtgatgccccaagccagataagaaaatgatgttatggagatctggaatcctcacccaaaagtccagctttcattctaaatgcatccgtccatcaggacagtcttgtgtgtgttcagaggtgagggatgaaagagaaacttcacagcagaagaccctctcaaagtcatgtgcggatctgcactgagtctcctgtttctccctcttccctagctatacctctttttaagatccaaaagggcagggctgacttaagccttctctagggccagatattcctagacgaaaacaaggggcttcttgagaggaaatgaaaggagacggagatgcggttttgccttaaggtttttaatgtgagccactgagaagattcattttgaaatagaaggatgtgtctgacagtgtgatgtaaatgcaggcattttggagtccctgctggagaacacacagaggtgagtaggggttctccagtgaccttgtgggagtctttggctgggaagctagctgctggagctgaaagggcacaggaatagaaaccacaccacctggggtcttctgatccagtgttttccaaagggcaagtgccatgtgagctggttttagactgcaaaggagcaactgattcaacagtaacaaattacaaatgaaaacttttcccatttcaaagttacttttcagttcttctgatgctaaggagaaagtgtcggttttaggctattgtctctctttttttttttttttgagtcagagtcttgctctgtcgcccaggctggagtgcagtggtgcgatctcggctcactgcaagctccggctcctgagttcacaccattctcctgcctcagcctcccaagtagctgggactacaggtgcccgccaccacgcccagctaattttttgtatttttagtagcgatggggtttcaccgtgttagccaggatggtctcaatctcctgaccttgtgatcctcccgcctcggcctcccaaagtgctgggattacaggcatgaggcaccgcgccaggcctattgtctctttaatacctctctatcacttgttgatctctcttcttaaggagggcaagcactcttcagccttagaggcattagcaggcaacagcatctattctagtggatctcatccttggctgcatgatgctatttcctggggagagctttaacaaattacttatgcctaattgcttcctccccagaggaattccagtttaatagctctaaggtctggcttgggcattaggatttttagaagctctccagacaacggtttctaattagaattgttttgtattatatttattaaccttctattaatggcacgtgatactagttttctactgaaggcattgaagtaaaatttcctttcaacatcagttgacttacataaaaacagtaagtgcctgttaaaggaaaataaaaactaaaggcaggaggattacttgaggccaggagtttgagaccagtctgggcaacgtagtgagaccccgtctcttaaaaataaaagccaggcatagcggtacgtacctgtagtcccagctgctgaggaggccgaggtgggaggagtgggacgatcacttgagacagggtgtttgaggctgcagtgagctatgatcatactactgcactggtgtgacagagcagaaaaaaagaagaagaaaaagaaagataactaaataatgcaggtggtatttgcatatggcaaaaacaaaatatgcattcagtgaactttgccaaactctcttctggtcctggcttagctctcccattcctgtcttctttaggcccagtttcctcaacaatgaaatgggactaattatcccaggtcacacttctctctgggcttaccctgggaatcagatgattgagctttggtaagtattatttgataaacaagtatgaggaaggaaataaaagggagatcagtgctgcagagatggctaattggcagatttacacagaactggattttttgcgtatgttaaaccaggctatttggaacttctgagttccaagtaccatcttctctccctctgcatcagaatgatccactggtctccattaaaggtatcatgattgccaataatgatttagttctccagtggcaataaactaaagaacactggaagtcccaccaagactcccaaggatagcgtgttagcatacaagctgaatagcctgtgttgcagtccctgctagtcagggtcttctggataatgcattgcctgtgtgaggactggcctggtcctctgcaggctgaattctgcatttagcagctcagtgtcccttccacgggccccagtttcttcatcaggaaggtgaggggcttggactagtgtaggatcaggtataaatgcaaatacctccaataccaaggaagtaactcaggtgtgaggctctgctaagggaacagggagtggtcaggcttacagcaaagtagagagcgcagtcccacaataaagatactcagattcaagttttgaaaaccagggggttgttaaacaacagtttggcaaggtgacagttagtgattactggatgtgatggtttctaagattcatttctaaaaataattttataatagtaaaataaatccaaggtgtctactggggtttttttatatcactgctgtactcaatggtacccagaggcttctctgataataagaactaacacttagaataaaagctaacatccaaatgctaagttctttaaaaccatttaatcctcaccataactgtgtgaagccagtactattattacagccttataacatataaggaagttagggttcagagtgtttttttacacacattttacaaatgtgtgtaaaatctctagagcagcgttatccaatagaaatataaaatgagccatatatgtaattttgaatttttttagtagccatattaaaaaataaaaagaaacatgacattaattttaattatatattttatgtaaaccaatatatataaaatattatcatcttaatatgtaatcagtgtaaaaattaatgagatgccttgtgtattttttgcattgtctttaaaatttagagtttcttcttttttttaaacaaatagccttattgagatataattcacatactatacagtttgcccatttaaagtatacaattcaatggcttttaatatatttacatatgtgtaacaattttaaattaaaattgtgtaaaatttaatatattcacatggttacacacaaatggttacacatatgttaatatactaaattttacacaattttatatttattatttatttgatatataaatattatttatttgaggcagggtcttgctctgttggccaggctggagtgcagcattgcaatcataactcactgaagcctagacctcctggcttcaagcaatcctcctgcctcagcctcttgagtagatgggactgcaggcatctaccaccacactcggtattaactttttaattttttgtagagacagggtctcactctgttgcccaggctggtcttaaattcctgggctcaagtgatcctcctgcctcagcctcccaaaatgttgggattataggtgtgagccaccgcaattttagaaagttttcatccccttgagatgaaatctcctatcttttggctagcactcacctaccaccctgaccccatcctcagccataaactacccctaatctaatttaaatctctatagacgtccctattctttttcatgtgactattctgttatcccagcaccatttgttggaaagaccattttcccccactgaagggtcttggtacccttgccaaaatcagttgaccatagacatatgggtttatttctgtgctctcaatgttctgttccattgatctgtatgcctatccttatgccagtaccatactgtcttgactattgttgttttgtagttaagttttgaaatagagaagtttgagtcctcatactttattcttctttttaaggattattatggctattccagatctcttttaattccatataagtttctaaatcaacttgttaatttgtacaaagaagtcagtttggattctgatagggaatgtgttgaatttacacatcagtttggggagtataacaatgttaaggattggaaaacccgtgattatagggttttctccatttatttagaccttctttattttctcaacaatgttttgcagttctcagcatataactttcatttcttttgttcaatttattcctaagtatttaatactttttggtgctattgcagatgaattttcctattaattttcatattggtcattgcaattgtataaaaatacaattatttttgtatattgatcttgtttcatgcaatcttgctgtgatggttaattttttgtgtcaacttcactgggacatgaggtgcccacatatttagtcaaacattattctatgtgcttctgggaggatgttttggattagtttgacatttaaattgatagaaattgatagactgagtaaagtagatttcccttcgtaatgtagcttagcctcatttaatcagttaaaagtctgaatagaaaaaaaggctgaccctgcccacaaataaaaaggaatttcttctgcctgactacctctgagctgcaacatctgttttttcttgcctttgaacttgaattgaaacattagctctttctgagtcttgagtctgctggctttcaaactagaactacaacattagctttcctgaatgcaaatcaaaaccacaatgagatgccatctcacaccagttagaatggcgatcattaaaaagtcagcaaacaacaggtgctagagaggatgtggagaaataggaacacttttacactgttggtgggactgtaaactagttcaaccattgtggaagacagtgtggcgattcctcaaggatctagaactagaaatactatttgtcccagccaacccattactgggtatatacccaaagaattataaatcatgctactataaagacacatgcacatgtatgtttattgtggcactattcacaatagcaaagacttggaaccaacccaaatgtccatcaatgatagactggattaagaaaatgtggcacatatatgccatggaatactatgcagccataaaaaaggatgagttcatgtcctttgtaaggacatggatgaagctggaaaccatcattctgagcaaactatcacaaggacagaaaaccaaacactgcatgttgtcactcataggtgggaattgaacaatgagaacacttggacacaggatggggaacatcacacactggggcctgtcatggggtggggggagaggggagggacagcattaggagatatacctaaagtaaatgatgagttaatgggtgcagcacaccaacgtggcacacatatacatatgtaacaaacctgcacattgtcttcatgtaccttagaacttaaagttattttaaaaaaagccacagaactcttttgtaagtaaataaaaaattagctttcctggttctcagacatttggactaggactagaactaagccattagctcccctgggcccccagcttgtaggcttcagattttaggactagtcagcttccataatcacatgagcgaatttcttataataaatctctgtgtgtgtgtgtgtatatgtgtgcaatatatatacattctcttggttctgtttctctggaaaccctgataaattatacttgttgactcaaataatttctcgctggtcttagaattttttatattcaatattatgtcatgtttgaatagagataattttacttctcttttccccaatctgaatacctttaaattcctttttttttgttgtctaattgcactggctaatactttcagtataatgttaaatagaagtggtgagaatagatattcttgtctcatttctgatcttaggagaaaacatccagtttttcatcactaagtatgatgttagctgtgagttttttcacagattctctttattaggttgaggaaattcccttccattcctaggttttttgagttcttattctttttaatattatagaagagtttgggtttcataaaatctttttaaagcatctattgagaagattatgtggcttttgttttttattctattgatatggtgtattatattaattgattttttgatgttaaaccaaccaatctttcattccagggatgagtctcacttagtcatgaaatgcagtctctttgtatgttgctggatttagtttgctagtactttgttgagaatttgtgcctccatattcttaagtaattttggtctgcagttttttttttgagatgtgtttgtctggttttgatatcagggtaatactaatttcatagaataagttaagaagtgtttcctcctcttttattttcttggaagagcttgtgaaaaattgacattacttctttaaacgtttggtacaattcagcagtgaagccatttggtcttgagcttttctttgtgggtaatttttttatcacaaattcaatttctttggttgttagaggtctactgagattgttggtctaagatggtctaagttatttaatttattgacatataattgttcataagaatattataattattttgaatcctttttaatcctttttatttctataaggttggtagtaatgttccatcttttgtttctggttctagtaatttgagttgtctcccttttttctcagcagtctaattaaaggttcgccaattttgttgatcattacaaagaaccagtttttgatttcatcaatttttggaatggtttctttttcctctattttatcattttccactctaatctttataatgtccatccttatgctcactttaagtttcatttgcttttcttcttccaatgttttacggttaggttattgcttagaggtctttcttctttttctaatatatgcattacagctctaaattgtcttctgagcggtgatccagctacatttcttaggttttggtatgccatatctttattttcttctatctcaaagtacttttaatttctcttttgattatttctttgacccattggttatttaggagcatggtatttagcacctcttaaactggaatagttacatttcaagtgcctaatagccactatggctggttgttagcatattgaacagtgcaactttatagagttattcagtgatgcaagttgggagttgaacctggtttatctgattccaaggaaataatctttgcaaactgtctctccaatatgttaaatgtgtaaaatagcaagccttgctaattagccactttaggaagtttaattactttattttgggaaagtaattttaaacattttaccttttaaattattaaataattttttatttgtgtatactttaggcatacaacataatattttaatatccttatatatagtgaaatgattactacagtcaaataaattagcatatctgtcaccttttatagttaccttttaagctttaaaaaaattttaaacatagcacacatgtagaaaaatgcacaaagtataaatgtacagctcaataaattatcacaaaacaaacacacatgcatccactgcttagttcaagaaatggaacattgccaatcacttcagatgtcccctctgtgccactgcccaatctgtatccttctcttccttccaaaagtgatcatctcacttctaaccagagttggatttaccattaagacaatagagcctaagctataggggccctcatttacacagacctcttccaaagccctaaggtggggtggagcgctcagtaaagtgttcatatggtcatttgtcatcatttttatgtgtttttgtaaattttacataaggagaatattttgaccatagtcacttaaggtggtggtgctttctactctgactttcctgccttcacattttgccttttgttgagtggtaatgagatagctattgatgtttttggggtttgtccaagccttagactctgagggtaggggagttgaggatatattttattgaggtcagcaagatttatttatgtgactccaagtcacttccatattcaaacagttaagttcatgtaggattatatatcataagttatttatatattgtcctgctgatgaacgttgggcttattttgagttttttgttataacaaattatactgacacatcatttttgtatatttcttttggcaaatatacgtatgcatttctttttccttttctttctttttgttttttgagacaggatctcactctgttgcccaggctggaatgcagtgatacgatcatgactcactgcagcctcaaactcctgggttcaagtaaccctcccacctcagctttctgagtaactgggactacaggtatgtgcatccccactcagttaatttttaaattttttatagagacggaggtatccctttattgcccaggcttgtcataaactcctgggctcaaatgattctgctgccttggcctcccaaaatgctggggttacaggctatgcatttctttttgctatacctctctatgtatgaaacaaccagctcatagggtcatttgtatgttcaactttggtagacatagcaaactggtttccaaagtgggtataaacacatatgttcctacaagtaagcacatgagggtttcctttgctttacacctttgccaaaaaaaaaaaaaaaagaataagtagtttttacgtttcagcaattctgatgaggttgtaatgttatttcattctcatttaaatttgtatatccctgattatttttgaggccaggcaccttctcagtctatcagttatctgttaagttttgaatcgatttgtccattggttgtcttaccttattgattggtagaagcccttaattttggcatgagctctttattagttacatgtgtggcaaatattttctcccactcagggacttgctgtttcactctcttcatggtaggttttgatgaccagaagttcttaaatttaatttaggctaatttattaatccttttgtttcaggttagtattgttttatttaaaaactgtttcctgggctggctcacatcccagcacatttgcagactgaggcaggaggactgcttgagcccaggagcttgagaccagcctgggcaacatagggagaccccatctctacaaaaaattaaaaaattatccaggcatggtggctcgtgctagctactcgggaggctgaggtgggaggatctgcttgagcctaagaggttgaagctacagtgagccgtgatggcactactgcaccccagcctgggcaacagagcaagaacctgtctcaaaaaatacaaaataataaaaaataaaaactattttcacactgcaatattatgaagatattctcctattaccataggataatgcttcctttctaaagcattattggtttgtctttcacatttagatatataattcacatagagttgatttttatgtatgatgtgaagtaaaggtcaagtttcatttttcttatgtggatatgcagttaacttagtaccacttattgaaaagattgttttttctccactagtttgcagtgactcatcattagacaagtatctatatattcatgagttatctcttcttcttcattgatctactggtctactcttgtgccaatactgtgttatcttaaaataaatcttttttttttttttttttttgagatgaagtctcactctgtcacccaagctggagttcagtggcacgatctcggctcactgcaaactccacctcctgggctcaagcaattcttctccctcagcctccagattagctgggattacaggcatgtgccaccacactgggctaatttttgtatttttaatagagacggggtttcactatgttggccagactggcctcaaactcctgacctcaggtgatccgcccgcctcagcctcccaaagtgctgggattacaggggtgagccaccgcacctggcctaaaataaatcttttaatgagtagaagcagtcattctatcttattttttctgtttcagaatgtcttgattatcgttggtccttcacatttccatatcaattttagagtcagcctgtcaattttcatacaagtcctgttgaaattttattaggattacattgtatcagtagatcaatttggacagaattggtacatggatgatacccaatatcataaatttattatatttggtatttactaaccgatacatgtgatctaccacatgcttaatttatttgtctattcctgacttcttgagatgaaagcatagatgattgttttttccccagcctttcttgtttcttaacatattcattttaaggttgcccgatgagcatgcttagttggattccccaaaataattagttagttaatttgttgactgattgattgacacattgctagctcctctcagactgcccagtcttcctcatgcccaaagggctctcattctgttcatgataacgcccaaaatctttaccttggcacactcgtttctccatgatctgcccctactccctaatcgctgtcacctcctacaatttgtccccttatccaccttgctccaaccacactggcctccttactgttcctcaacaacatcaaacacactcctgtctcagagcctttgcccttgctgccacccctatctggaaggtttatactttaaatagccaaaaggcttttcctcttccttcattcaggtttcagctgaaatgcacctttttttggaaagaccttccatgactacgttatataaaatggcattctctagcacccactatcacccatactttgattttatttttcttcataatgatacttcccaactgacacaaaataaatttacatgtttatttattgtttggctaccattttcttctctctctagaatataaacttcatgaggataaggatttttttttctgttttatttacttctgtatctccaaagcccacaaaatgtgtggtacatggtagatgatttataaatacttgggtgatggattctgtacttggcgtcagaagatctggattaaatagttctgaatctgcctcttattagccacgtgaccttgagcaaccaaatgaaactttctaagcctcgattcctttaatggtgtagtggaataataattattgcccctgagatactgagtgtaaaagtactttatgaagtatacaaaatcatcatagacatttttcgatattattgtcagaaaatgtcttgcttgtcccaaatttctttctatttgaacttccttggtgataaaaattctcctgtgggagaatttttgttgtgaacattttggacattttgttgtgtttgcctctagctaaaacatgagcatttgttcctagaagggataacatttttacacttctgttgccattagtatgtgagcaagaattaatatatgaactcattgtcactgatgacatgtgatatgggtgggtaggttttggtggagaaagcactaagcaaaatgtctagagcattgtggggaggggagtgctgaaaaggccattctaagtgggtgcctgggggaaagattaaaaagttctttattagtcaggttaggctatgttatattgcagcacaacaacgtcaaattctcagaagcgtatcaggaaaggttaatttcttatccaaatagtcttctgtggtttcatactactctccaggggttgggaggagatagttgtattatttcacatgcctgtgtggggactttttagggaatcttagttaaacaacttggataaatttaataaagttttataagactaccacagtacaaatctatcttggcaaaagattttacagtttacataggaatatgcttgaaaatactattgttattttctagcccttttggcatagagtttaggtataattatcacattttcaactgcaagttgtatcatgtgttttgatggatacgtatgtttttggggaaatgggactcattatttgaattagaacctttaaaagaatgctaccatttattgagcaattattgtgtaccaagtagcacagtaaaagctttgaataccttatctcatttgatgttcaaaacagcttcctgagggagatactattactgtattcaccttatagtgaggaaactgatgttcagagatgtggagtaatttgtctccagtcacacaaataagtggaagaactcaggccaaattcaggtctgtctggcttcagaacttgtggtctttaccgcaacacaatgctatctacctctccccagataatatattctgcatgtatgattgccataggtctatcagcagcccaaaatagatgatgacaatgaatatattaatataatagggttatattaatgatttcacagcatttgggcctgagtgtagaatcccaaagatgttctgttgtgtatgtttaacattcccagtgtcacaatcactcctttgggttaagactttgcctgtgatagacccaggtaaaatgcaaatatccttcatgggagcaaaaataaattaacacaatcactatgaccagcaagaaatagctgatttctatcatcagggaataaccaaatgaagaagacaaatttaaaatagtttgttagaaagcaatttaatataacatataatcaaatgaaaacttaaatataactgagtggaagttatattttgcagaactataatgggtatgccaatgagggaagggttttataattgaaaatagttatcaggaaaggattcttggagtagttggcacttggtgtgagtcttgagtcacttggaaaccatgtactatatgtgtctaataatcctgattttaaaaacctataataagtctctcttttttttctgcccataagagtccacctgtttccatcttctgtttctctgcaaaaatgctggtgcttttcactctaatcatgtgacttgaatgggagctgccatctttttagagctctttctcctagacagtgttgattggctcagagataggcacttgatttagtccaggctaatcagaatactcaaacttatgtccacagttggtgagttcagtgataagtacctgacccaagattggtcaattctatcaatttgtaggatatttgcatttgagactagaaaaagtgaatctcaattcttctatgggttttgcttctgtgttgtaagatttgaggtactagagctctgggtggccatgttcctggttggtctattctaagaaagaatgaggtgccctgtggggttaaacagaaatgagagatgcaaagagtgtaaggtggcatttccatttctggtctctgagctctacctttatgcactgttttagctgttcagtctttatctaaataacttctaataactccactgccaccgccatctagctatgctcttgggtaatttgagttgaatttttgtcacatgcaactgagagtcctgactagtatttcattgtgactttatattgaaataggcagaataaaaattatctttattttacagagagaaaatgaggctcagaaaaaatatgtaaccaagatactaaaaaaagtataggagttaatccaagacaaacattagatcttctctcactggagaaaacattggtaggtacaaggagctaggtcatgaaaagtctactggcttaggagactcagtatatgaactatgaataaaatagcttcccacctcttagggtattctgaatgttctgacactagattttggtatcattttaggttgggtttttttattgttgttgtttttgtcagtaaaatcctggcttttgaggaaaaaggaggaagtccaattccaccacagaacccacttcccttttgactttaggtccatggggttgcccaggtctgaaataagttaataactatctcttttgtactgtagtgatgtaaccctgaaaagaatgggcttttggtaaggattaattttaaaatgataccaaatgattgatcgttccactcttatcaaagcatactcgaatctgtactaacccagggatacagaaagattcagaaagcacaatcctttgaattttaggacaaactttacttagagaagtatctccttaataaacaaaaaaagaaaataaacttgggacgtttaaaactttacattttgccatatttcaaataagatttaagatagcttaaaagaatataaacatataagagacaatttaagttaaaagtggaagagaggccgggtgcggtgactcatgcctgtaatcccagcactttgggaggctgaggtgggtggatcacttgaggccaggggttcgttcaagaccagcctggccaacatggtgaaaccccacctccactaaaaatacaaaagtcgggcatggtggcacatgcctgtaagtcccagctacttgggtggctgtggcaggcaaatcgtttgagcccaggagatggaggttgcagtgagtcaagatcgcaccactacattccagcctgggtgacagagtgagactctgtttcaaaaataaataaaataaaataaagtagaaaagaaacaaaaattataagatagggacattaaatggagttagaaatgaggctaataaataatgaatatgctgcaccgtggaatactactcagccataaaacagaacaaaataatggactttgcagcaacttggatggagctggaagccattatcttaagtgaaataattcacaaatggaaaaccaaagattgtatgttctcacttgtaaatgggagctaagctatgaggatgcaaaggcataagaatgactttggggactcagagggaagagtgggagggaggtgaggaataaaagactacacatattgggtacagtgcatactgcttaggtgatgggtgcatcaaaatctcagaaatccggccgggcgtggtggctcatgcctgtaatcccagcactttgggaggccgaggcaggtggatcatgaggtcaggagatcgagaccatcctggctaacacggtgaaaccctgtctctactaaaaatacaaaaaattagccgggcgtggtggcaggcacctgtggtcccagctacttcggaggctgaggcagaatggcgtgaacccgggaggtggaagttgcactgagtcaagatcacgccactgcactccagcctgggtgacagagcaagactccgtctcaaaaaaaaaaaaaaaaaaaatctcagaaatccccactaaagaatggatccatgtaatcaaaaactatctgtacccccaaaactattgaaataaaaaaaaaatgaatgtgacacagtcctatatgtatttggcaactagccccaagttgggttgggctttaagctttcttgttgtcagtgcaaatagagaaactcaaccaactacagttttgcaatatccacgagacaaatgtttaggaaaagtacaactacatctaacactatgtccagaaacaatgtgtccctgggttcttacaaagagagcactgtattataaaatacagaaggcctgaagatcctccttccaggagacccaaggatgaggttcacaggcctggttcttataggtggaagcattatttctcaaatttcaattgtctttattatttctgccatatatacttactaaattttagaaattattattattatcattattattattttttgagagggaatctcactctgtcacccagactggactgcagtggcatgatttcagctccctgcaagctctacctcctgggttcaagtgattcttttgcctcagcctcccacatagctgggattacaggtgggcgccaccacacccagctaattttttatatttttttggtagaaacgggatttcaccatgttggtcaggctggtcccaaactcctgacgtcaagtgatccgaccgcctcggcctcccaaagtgctgggattacagtcatgagcccctgtgcccagctagaaattattaacctaattttttttaacgtagattttattttgactcagttttaaacttaatcttagcaaggtagaaaagctagttatgtttttttctagtatcgtttaagtcaagtttataaggattaaaattaaaaagtctattttaatctaaaattttcttatgtaccattaatagtttgtaggccacaccttgggaaacactgacttaaggaaaaggaaaaatccagtatttggatatccatgacctcattgcattttaatatttctcgagaggtgtcatcttaatatttcctgagaggtattattatcaccaacagaggtggggaaacaggttaaagaacttttgtaaggttccacaataactgagcagagatgaaactcaagtcttttgatgaaaatcaagttctggcttctagatgggtgtagagaaggcctttttcccaaactgaagttcagactctctttgactgtttacccctttgcttcctgccagaatgccccaccccacttagtccatagtgatgcccacctgtggttaatggagctgaggctgctggaccaaagggaggaagtctgttaggcatatgtggaacccaaaagaggaacttcatcaactgtcatggacagctctgccactttgtgaccctgtggactttttgggaagtgtttttgtggttcaccagtctctcattaggcaaggccatttgtcctgggttggtcttcttcattggtggaaagtacagctgggagatttggaatggttgcagattgacttgactctcataaggaactgccaccatgagcttttggggaaagacctcaagctgtggtgtgttgctgaggattgtgggattcctccaaatcttggggaacattttgagtcatcactggcagcagatttctgttgacaacttgagcaacttcagaatgaagaagccatcttcatctctcacatgaatatgactttgggtaaatcatctcgaaatctgaacccatggttgtgatccacactcctcctgagttctgatttttagtgtaacctttttcttctcattttttcttctttgtgcatctcttaaggaggtttttaaaatctcataattaaaaaatttatttcttcaaaactttttattttgaaatcactgtaaattcacatacatttgtataaaatgccacagaaaaatcctgtgtgccttttactcagtttattctaatgataacatccttaaagagatttaaaaattactgagatataattgaaatatgagaaaattcactcttttatgcatttaaatatcctttatgttttttcatagcttattagctcatttcttttcagtgctgaataattcttaattgtctggatataccatagcttatttatccattcacgtattgaaggatgttctagttgcttttaagttttggcaattatgaataaagctgctgtatacattcatgtttaggtttttgtgtagatataaattttcaagctctttgggtaaatattccaagagcacttgccgagttgaatggtaagaaactacccaactgtcttctaaagtagtataccgttttgcattcccaccaacaatgaatgggagttcctgtttctccacatttttgtcaatatttggtggtgcctgtgttttggtgccattctaataggtatgtagtggtatctcattgttttattattcatatatattcattgggtaaagtgcaattttgctgttgacatattgcactgtggtgaagtcagggccttcagtgcatcatttatcactagagcaaggcacattgtacccaccaagcaacctaccatcacccaccaaccttctatccttctgagtctccattgttcattatcccagactccacattctgctttgtgtgtacacattatttagtttcctcttataagtgagaacatgaggaacatgtctttttgtatatgggttgtttcatgtcagaaaatggcccccagttctatccatgtttctgcacaagatataatttcattctttttatggttgaatagtattccattgtgtatataccccacattttctttatccagtcctccattgatgaacacttagattgattccgtatctttgctattgtgagtaatgctgtgataaacatatgagtgcagatatctctttgatatagtgatttcttatcctttgggtagatactcagctgggtaggactgctggattgtatagtggttctatttttagttccttgagaaatcttcatactgttttccatagaggttgtcctagtttacattcccaccaacagtgtgtaagagttcccttttctccaaatcctctccaacatctgttatttttttatctttttagtaatagtcattctgattggtgtaagatgatatttcattgtggttttaatttacatttctctgataattagtaatgtgtaacttttttcatatacacgttggctatttgtttatcttgttttgaaaaatgtctattcatgtctttagcccactttttaatgggattattttttgttgttgagttgagttccttgtaaattctggatattagtcccctcttggacgtattgtttgcaaatattctctcccattccacagattgtttatcactctgtcgattatttcttttgctatgcagaagcttttaactttaagtcccatttgtctatttttgttttcgttgcttgtgcttttgaggtgttcttcacgaattcttgactagcccaatgtctacaagagttttccctatttttttctagcatttttatagtgtcaggtcttacattcaagtctttaatctattgtgagttgatttttgtatttggtgagtgataggggtccagtttcattcttccacatatggcaattcgatttttcccagcacaatttattgaaaaggatgttctttctccagtatatgttctggtcaattttgtcaaagatccgttggctgtaagtgtgtggttttatttctgcattctgtattttgttctattaatctatgtgttgatttttatataagtatcatgctgttttggtaactatagccttgtaatataatttgaagttaggcaatgtgataccttcagctttttttttccccccttaggattactttggctatttgggctcctttttggctccatatgaattcatttcttctaactctgaatcctgaattatttactctaattctgtgaaaattgacattggtactttttttagacctcctgtgtggacatgacattggcattttgatagggattgcactgaacttgtagattactttgggctgtgtggtcattttaagactattaatttggccaggcacggcagctcacacccgtaatcccagctctttgggaggctgaggcaggtggttcccctgaggtcaggagttcgagaccagcctggccaacatggcaaaactctgtctctactgaaaatacaaaaattagccaggcatggtggtgcatgtctgtagtcccagttacttaggagactgagactggagaatcgcttgaacccaggaggtggaggttgcagtgagccaagatcatgccactgtactctagcctgggtgacagagcgagactccatctcaaaaaaaaaattaatttttccaatccataagcatgggatgtttttccatttttttgtgtcatctataatttctttcaccagtattttgtaattctcctttaaaagactttttacgtccttggttaaatatatccccagatattttattaattttttggtagctattataagtgggattgccttcttaatttggtccatggatagaccattatagaaatgctactgcatattaattttatatcctgaaactttactgagttcatttatcaaatgcaaaaggtttttggtggagtctttagggttttctagatataagattatataatcaataagtgaacaagaataatatgactttctcttttccagtttagatagcttttattatttctcttgcttgattgctctggcaaggacttgcagtactgtgttaaatatgagtggtgaaagtgggcatcttgtcttcttccagttcttagagggaatgctttcaatgttccccattaagtgtgatatttgctgtaggtttgtcatatatgggctttattatgttgaggtatgtttctttatgcatagttggttgaagatttttataatgaaggggtactgaattttatcaaatgcttttgctgcatctattgagatgattacatgttttttgtccttaattccgtttatgtgttgtatcacatttattgatttgtgtatgttgaactattcttgcatcctctttttttgttgttttttgggtttttttttttgagacatgatcttgctttgttattcatgatggagtgcagtgacacaatcatagctgactttaagctcaaactcctgagctcaagctaagggaggagaccacccctcatattgtcttatgcccaatttctgcctccaaagaaagaagtaaaaactaaaaggcagagatgaaatccacaggcagacagcctggtgccacatcctgggcctagttaaagattgacccctgacctaaccagttatgttatctagattccagacgttgtatggaaaagtgttgtgaaaatccctgtcttgttctgttctaattaccggtgcatgcagcccccagtcatgtacccactgcttgcttaattgatcatgaccctctcacacagacccccttagagttgtgagcccttaaaagggacaggaattgctcactcggggagctcggttgttggagacgtgagttttgccaaagctcccagccgaataaagcccttccttctttaactcagtgtctgaggggttttgtccgcggctcgtcctgctacatttcttggttccctgactgggaagcaaggtgattaatggacggtcaaggcagccacttagacggcttaggcctgccctgtgaagtgtccctgcgggggactccagccagcttgggcgacacggatcctgagagcacccctgggtaggcaattgccctggtggaatgcctcgccagagcagcacatggcaggccctcatggaggatcaatgcagtgactgaacactgggaaggaactgacacttggagtccggacatctgaaacttcgtaagactagtctttggaacttgccctctccatttgagtggaagcgtggcctgatcacccacagtgtgcctataccagcactttggtttttgttttgatttgacttgaattgcttaatactttggttttggttttgacctggcttggatttcttgatactctgattttggttttgattctgctttggtgtaaactgtaaaagtgtgtgtgtgctctttttacccgttctttgttttgtggtgtgtgtgtggtgtgagtatggtgttttgtctcaaagaagcatgggtcaggcacaaagtaagcccaccccactaggaactatgttgaaaaatttcaagaaaggatttaaaggagattatggtgttactatgacaccaggaaaacttagaactttgtgtaaatagactggccagcattagaggtaggttggccatcagaaggaagcctggacaggtcctttgtttcaaaggtatggcacaaggtaacctgtaagccaggtcacccagaccagttcctgtatatagacacttggttacactgattttaaacacccccccaacagtggttgagagaacagcagcataagcagctggcagaggcaaggaaagaccagcagagagagagagaaagagagaggcaaagagagagaaagagacagaggcaaaaggaaagtcaaagagaaaaagagacagaaaatcaaagagagaaagaaagagatatacaagtagttaagaaaaaaaaaaaaaacagtgcaccctattcctttaaaagccaaggtaaatttaaaacctataattgataattaaaggtattctccgtaaccctataacactctaataccactttgttgtcagtgtaaacaagggtgtatcccaaaagcactgaggccttcctatcaaaaatccttaacccagtaacccacagatggcccagatgcattcaatctgtagtggcaactgctttgctaacagaagaaagtaaaaaaaataactttgagaggaaacctcattgtgagcacacctcaccagttcagaagtatcctaaaaagaaaaaaaaaaggataatttaacactaaccaatgaaaattcccttaacccagcaggtttcctaacaggggatctaaatcttaattaccatacaaaggtccaaccagacctaggaggaactcccttcaggacaggacaatggatggttcctcccaggtaattgaaggaaaaagaaagccatctatacgaattctaagttaatttggacaaaacaaggtcttattcatagcaaaggataattaaaatcccaagcttacatggttttcaacaaaagtaaagtttgctaaaagttaacagtgtaacatgtattatagtaacttctaatcttgtggccttagacagtctagtccacagacataaagcaaagaatggttaccgtctttggaaaaaaaaaaggaaaaaaagtgggggcagaatttatgtaaaaagaatgttatatggtaaattcttatcctgaaataaattaactggttgtttaaaaaaagaaatgtttgtaataagtcagaaagttgaggcatgtcgaagaattgtctgctaaagtcgtgaaagagaaaaatattataaaaaaagaatttatgcaagaaatgttgtataatttaaaagtaactaggcctcctgaaggtaaaaactattgagaaagaaaacagtttatgtgcatggtgtataaggaaggtaaaatatacctttagtaagaggattataaagaggcataagaatgtaaatttttacctacattaaaacattaaaaaagttattgttttgaaggtttaagcaagttttaaaacattaattgtaaagaaaattctgtgtgtaaacatatttgctgaagttaaaaagctatcatccagtttttctgtgaactggacattaaagtaaaaatacaatgggtttttcttaaagcactaacctgctctttaacaaagattataaaaggttaaaaagagtctataaaaatcttaccttatggtccaacattaaaaattgaataaatatgtatacaaattttattaaaactaagtttaacattaatagcacactaatataaaggtgaaatttagcttatctggtataaaaatcatacaagaagcattattaaatataaaatgatgtttggctttctttggtctaaaaactaataaaaataggtgctaaaagaaatttctcagtaagaaggcaccaaggactataaagtccactgatgtccccacatttaaaacaaaaggtcagtttcttagaaattatgtacttggcctatcttccactttcctttccgtcaaaactaaaagtcttttagcacaggtaccacccctagaatttccagtaaaccatcactagcctgaagatcaccttctcatcaaagggtagaaagaagaaaaactcaagccagcctaggaaggaccctaccttgtgcttctgaccaccgagactgctgttcatagagtgaaagaaggatggactcatcacacctgagtcaagaaagcaccaccccctccagagtcgtgggccatagacccaggggaaaaccttatcaaactaaagctaagaaaaatttaactctttcatctattctattactctttcttctttccttgctctattgctgaccatctagttattaacataaccaagtcaatttcgcctcacactattgcatttaatgcttgccttgttataccctgtggggacttgccaagtcaaagacagctctctacttcagaaaagtacttctgtccttcctgactctcctcagactgggcattagtaaattaggaccatttaatctggggaaatttcgataaagactccagtgtcaaccaggagtcttgccccccaatgtacagcttttatgccatagttggtccaacgttctgtggacaactaaagagcaaggatggactgccctaactggtttttataatttcctaaaatcacacattcattttactagaggattatagaagttaaagacttaaaacaaactttggcaattaagacagcataccaagttgcaaatgcctggttggaatggatcaaatattccatctgcaggttaaacaaaagcaattgttatgcttgtgcacatggcagaccagaggcccagattgtcccctttcctctagggtggtcctccagtcgaccaggcatgggctgcatggtggctcttttccaggattctacagcctggagtaataagttgtgccaagctctctctgctatatcccaaagttcagcaccttgcaggtcagcccctgagggccatccagcctccgtctcccaacactaagttcacttcatgtctctcaccacagggaggaaacttaacattccttggagacctgaagagatgcagtgagcttaaaaattttcaagagcttatcaatcagtcagcccttattcatccctgagcagatgtgtggtgttattgtggtggacctttattgggcactctgctgaataactggagtggcacttgtactttagtccaattggctatccctttcaccctggcatttcatcaaccagagggaggaaaaataagacatcatgaagcgagagacaccccttattggtctttagactctcacatccatttagatgcaattagatttccacgggaaataccagatcaatttaaagcttgaaatcaaatagctgcaggatttgagtcaatattttggtgggtgacagttaataaaaatgtaaattggataaactacatctattacgaccagcagcaatgagcttttcatgagttaaaagaaaaactcatgtcggccacagccctggggctacctgacctaacaaaaccctttacaccctatgcatcagaaagaaaaaaaatggcagttggagttttaacccagactgtggggccctggccaaggccagtggtctagctctcaaaacaactagatggggtttccaaaggctggcccccatgtctaagggcctggcagcaatagccatgttagcacaagaagcagataaactaacccttaggcaaaacctgaatataaaggccccccatgctgtggtaactttaatgactaccgaaggacgtcactggttaacaaatgctagattaaccaagtaccaaagcttgctatgtgaaaatctctgcataaccattgaagtttgcaacaccctaaaccccaccaccttgctccctgtatcagagagtccagttgaacataactgtgtagaggtgttggactcagtttattctagcaggcccaacctctgaaaccatccttgaacatcagtagactgtgagcagtacgtggatgggagcagcttcaccaatccctgcaaagtgactctgaagaagatgactagccctgctccagaagctgactggtccacacatggcagaagcatgagaaaactcatcatgggactcattttccttaaaatttggacttgtacagtaaggattttaactgacctttctcagactgaggactgttcccagtgtatacatcaagtcactgatgtaggacaaaaagttgctacagtcctattattttatgattattataagtgtactgggactctaaaaaaaaaaaaaacttgtttgtataatgctattctattaacagtatgtagcccaggaaatgaccaacctgatgtgtgttatgacccatccgagcctcccatgaacacagtttttgaaataagattaaggactgaggactggtaaaggctcataaatgatacgagtaaagtgttagccaaaacaaaagaaaaaggggtgcccaaacaagtcaccttgaagtttgatgcctgtgctgtcattaatagtaataagttagaaataagatgtggttctcttaattaaaaaagaggctatatggcagaaaataagtacatttgtcatgaactaggactgtgtaaaaataaatgtggatactggttttatgtcgtttaggctacttacataaaaaataaaaaggatcctgtccatcctcagaaaaaaaaaagtggcccttcctataccagtggtcagtttaaccccttagaactagtaataaccaacccccttgatccttgctggaaaaaaggggagtgtgtaaccctaggaatcgatagggctggactggatcctcgagtaaatatcatggtttgagaagtttataaacgctctcttgagccagtatttcaaaccttctgtgataaactgaatgtgccagtaccagaaattccaggaaaaacaagaaatttgtttttgcaattagctgagcatgtagcccagtctctcaatgtcatttcatgttatgtatgtagaactgtaataggagatcaatggccatggaaagcccgaggattagtacctacagatccagttcctgatgaattcccagctcagaagaatcaccctgataacttctgggtcctaaaagcctcaatcagtagacaatactttatagcaaaagtgaggaaggacttcacccttcctgtaggaagactcagctgccttaggcaaaaactataataatactacaaaaacagccacctagtggagttcaaagcatgctaagaaaaatccatttagtaaattcccaaagttgcaaactgtgtgaacccacccggagtcccaccaggactggacagcccctactggattacagtggatatgggggtctagggcttacaccaaattacccaaccagtaggcaggtagttgtgttattggcactattaaaccatctttcttcctactgcccataaagacaggtgaactcctaggctttcctgtctgtgcttcccacaaaaagaaaagcatagctataaaaaattaaaaagatgataaatggccccctgagaggatcatacaatattatatgcctggtacttgggcacaagacagcttgtgaggatacctgacccccatttacatgctcaactgaatcatacggttacaagctgtcttagaaataatcactattaagaccggcaaagccttgactattctggcctggcaagaaactcagatgagaaacgctatctatcaaaatagattagctctcaactacttgctagcagctgaaagaagggtctgtagaaaatttaaccttactaattgctgtctacatataggtgatcaaaggcaagtagttgaagacatagttagaaatatggcaaaactggcacatgtgcccgtgcaagtgtagcatggatttgatcctaaggctatgtttggaaaatggttcccagcactaaaaagatttaaaactcttataataagagttataatagtaataaaaacctgcttattgctcccttgtttgctacctgtacttcttcaaatgataaaaagcttcattgctaccttagttcaccaaaatgcttcagcacaagtgtgctatatgaatcactattgatctgtcttgcaagaagacatagatagtgaaaatgaaaatgagaactcccactattgagtgagattctcaaagggggggaataagggaggagaccacccctcatattgtcttatgcccaatttctgcctccaaagaaagaagtaaaaactaaaagacagagatgaaatccacaggcagacagcccggtgccgcacctgggcctggtcaaagatcaacccctgacctaactggttatattagctatggattccagacattgtatggaaaagtgttgtgaaaatccctgtcttgttccgttccgttctaattactggtgcatgcagcccccagtcatgtacccactgcttgctcaattgatcatgaccctcttacgtggacccccttagaattgtgagcctttaaagggacaggaattgctcactcggggagctcggtttttggagacttgagttttgccaaagctcccagccgaataaagcccttccttctttaactcggtgtctgaggggttttgtctgcagctcgtcctgctacaaaacagtctttctgcctcagcctcctgagtagctgggactataggtgtgcactgccatacccaactgattttgaaacttttagtagagacaaggtctcactatgttgcccaggctggtctcaaactcctggccccaagcacttctcctgctttagcttcccaaagtgctgggattacatgtgtaagctgcaatgcctggtgagtattatctttgtaatgtgctattgaatttgatttgctagtattttgttgaggatttttgcatctatgttcatcaggaatattgatctatagttttatttttttgctgtgtccttgtctggttttggtattagggtgatattgatctcatagcatgaattagggataattccttcctcctcaatttttttttaatagtttcaggaagactgacattaattcttctttgtatagttggtagaatttgagtgtgaatccatctggttctgggcttttttgttgggggaagattttttaaattattgactaaattttgctattcattattggtctgtttaggagttttatttcttcccggatcaatcttggaaggttatatgtttccaggaatttatccatttcctctaggttttctagtttgttaacatatagtcgttcataatagtctctgatgatcttttgtatttctgtggtatcagttgtgatgtctcctttttcatttctgattgtgtttatttggatcctctctctttttgattaatctagatagtggtttatcaattttgtttatctttttgaacaaccacctttttatttcattgatctttttttctggtctcattttatttagttctgctctgatctttgttatttgtttccttcagctaactttgggtttggtttgttcttgtttttctagttctgtgaggtgtgccattaggttgttaatttgtgatctttctgcttttttgatgtaggcatttaatactgcaaaatttactcagcattgcttttgtagtgtcccatgggttttggtatgttgtcttttcattttcattagttttaatttttttaaattttccatttaaatttctttattgacccagtaatcattcaggagcatgctgttcaattttcatatatttgaatagtttctgaagttcctcttggtattgatttctaggtttattccactgtagtctgagaagatacttggtatgatttttatttttaaaaaattgttaagacttgctttgtggcctaaacatggtctatcttgaagaatattccatttgctgataaaaagaaggtacattttatagttgttgggtagcatgtcatataaataattgataagtccattttgtctaaagtccaatttaagttcaatgtttctttgttaattttatgtctcaattacctatctagtgctatgagtggagtgctaaaatctcccactattattatagtgttgtctatttctttagatctagtaacatttgttttgtgaatttgggtgctctgatgttgggtgcctatatatttaggtttgttatatcctcctgctgatttgatccctttatctttatataattaccttctttgtcttttattaccattttttatttataacttgttttatttgatataagtatagctacttctgttcacttttggtttctgtttgtgtggaatatctttttccatacctttacttttatcagtctatgtgtgtctttatggataagatgactttcttgtagacagcatattcttggatcattaaaaaaacccattctgttttttttcaagatagtggataggaggtagtgttagtgtccttctcccacttgaaaggacagaatagtgggtggagattcatactgttaattttttttccatgaattaccacaggaacttgtcaggaaaactgaaagaattcacagagcctttgaaagaagcagcaggcctactccatgagataggtgaaaaattaaaagttcccagagtgtgcgagggggagaacctgcatctaaacacacatccctactggggaatctgaaaacccagatcatgggagaaggccttaaccctactgagagctggaacaaatttagggagaaaagtgagatattaaagtagaagcagcagtgggaagtgccttgtaggcattcacaatctgcagcatgagcccagggaagctattcctgattatttcccacaggtacccttgcggaagttagccaatgaacccagggaggggtcacagagtgaaagaagctcccaactgaattttgtgatataattttgagtgggaacaaactctcttgaacagaatccaggagtgagcaggaagtatgctgcagacgcaaacacagaagctgggtgcctgccttccgggcagatggggaagggaatggccttaaagctgttattgctgtctctctgggggagcttatggcttgggtcaggtctgagttctgtgtgcagactgcctggatctaaacctggtgctgttagcgggacactgtgggagtgagaccagcctcaccaactgtgtgggagctgggtgggacctactgctgtcagctaatcctcactccctttgtgaactcttctgcacagtagagacagttatactttcttctggaacattatcctggtggcctgggaaccaccctctgttccccacagtggctgaggcaggccccggacaaggagagtctgagctcagacctgcctaatcctgaccctacctgatggtatttctctacctgccctggtaacttaacacaaagacataaacttttgggagctttatagccctatccattgcctgagaagctagaatacttcccctggacaatttaggaaaagcttaaatcctactgctagtaatgcagctggtactcttttgcaagtgctacctcccagctggaggccaaccaactcaggccattacagcacctctcaacagaataacactgcacccagggaagagaaaatgatgcctgcaacatgctggctaaccagaggtcctgagtctgtccatgtcacaaattcactgctagcataactggcatttgagaaatccagcatgctaaacctatttacaaccaaggagtctcatagagtctacgtcactcccctgctgtcactatcagagcagatgctgggtatccactgctgggagacctgaaatattcctcagcaccagcccaaagcctggtagtcccactggtgggctagacccagaagagcaataattaccactgcagtccagctctcaggaagccctagtcctggcggaagtgggagagcaccacatcaatggatcaccctatgggacaaaataatccaaatggtgggcctttagtcccagatctttctactggtgggaagtttcttatagcagagacacagttgcagagctgggcacagtagggaaaatctgtatgcctatgtcaaccggcaggcagcctctgtgatcataaagggccttggagaaggggtccttgttcccccggcacactactgcagacacagctggggcttctcccatgggaatgaagcatggatgcatctgtaggcagccttcctggtacaatttagggtgattgtagccccataggaggagcactccctagattcaggcctgcatgagaagcagagtcacaattcctccatagttggaagattaacatttctacaatgaaaagaggtgcttatatgatctgaatagctggaacactgggacaggagtgaggctgtgaggtgaatagcctacctgctggcctggcaggggaattgaggtatctcccactcttcattttgataaaatctctgaacatctaattgagagcttccctagccacattcatcaagggtgggacttctgctctccagtgggtattatatctacaaacctgctttagctacaaccagtgcctacctaaggatacctcccttattggcctgaagcctgaatcatcaactcagtaaataaaatactgggaacaattaaacaaataaagtgaatactatgagagaatgagataagcctcaagagattgctaccattccagccccataggacacagtgaactggcccacactccaagtacctaactactacaaccagagcacaaagactctctatgataaaggaactcatacagtgttttccccctaaaagcaccaggaatcaaattatgttaaaataaactgtaaacattaaagtcagaaagtctgatccttaaaagggggaaaaacagaaatagaaaaaaaccccacagtcaaaacaaaaaaaattaagaataatttgaagaaatagtctacctaaataagaaggaaccagaaaagtaattctttgaatatgaaaaaacagggttctataacacccccaaaagatcattctagttccccagaaatggatccaaaccaagaagaaatttctgaaatgccagataaataatcagaaggttgattattaagctactcaaggatataccagagaaaggtgaaaaccaacttaaagaatttttaaaaattcagaatatgaatgaaaactttttcagagaaatagatatcataaagaaacaatcagaacttctggaaatgaaagatacacttagggaaatacaaaatgcggtggaaagtttcaacaatagactagaataggtagcaaaaagaatttcagaactcgaagataaggcttttgaattaacccaattaaacaaagacagagaaagaaaataaaaataggacaaagtctctaaaaatatgggattatgtaaaatggccaaacctaagaataattggtgttcctgagggagaagagaaatctaaaagtttggaaaacttatttgagggaataactgaggaaaacttccctggcctttctagagagctagacatccagacacaagaaactcaataacacctgggaaattcattgtaaaaagattatccccaaggcacatagtcatcagactatctagtgtgaaaatgaaggaaagaatcttaagagcagtgagaaaaaaatatcaagtaacctacagaggaaaacctattacattaacagcaaatttctcagcagaaaccttaccagccagaagggatttgggtactatctttagcttccttaaacaaaataattgtcagccaagaattttgtatgcagcaaaactaagcttcataattgaaggagagacaaagtctttttcagacaaacagatgctgagagaatttgccactaccaaaccagcactacaagaaatgctaaagagttctaattcactaaacaaaacctcagtatacaccaaaatagaacctccttaaagcataaatctcacatgccctgcaaaacagtaacgcaatgaaaaaaacaaagtatctaggcaacaactaacatgatgaatagaacagcacctcacatctccatattaactttgaatgtaaatggcccaaatgctccacttgagagataaagaatggcagaatggataaaaatgcaccaactaaatatttactgtcttcaagagacccacctaacacataaagactcacataaacttaaggtaaaggggtggaaaaaaacattttacgcaaatggaaaaaccaaaagcaagcaggagtagctattcttatatcagacaaaacagactttaaagcaacaatagtgaaaaaagacaatgaaagacattatataataataaaaggattggtctgacaggaagatattacaatcctaagtttatatgcacctaataccagagctcccaaatttataaagcaattactattatacctgagaaattagataggcaacaacagaacaatggtggaggacttcagtattccactgacagcaataaacagatcatcaaaacagaaagtcaaaaagaaactattgtgggaaccagcccccaatatttcaacataggttctttctattttccctaagtgttggccggtctgagaaataaagagaaagagtgcaaagagataaattttactgctgggcctccgggggtgtcatcatataatggtaggaccatgatggcgaccctgagctgcaaaaccagcaagtttttattggggattttaaaaagggaggaggtgtatgaacagggagtaagtcacaaagatcacatgcttcaaagggcaataaggatcacaaggctgaggcaaaattagaattactgatgagggtctgtgtcctgctgtgcacgcattgtcttgataagcatcttaacaggaaacagggttctagagcagagaaccagtctgactagaatttaccaggctggaatttcccaatcctagtaagcctgaggatactgcaggagaccagggcatatttcagtccttatctcaactgcataagacagacactcccagagtggccgtctatagacctacccccaggaatgcattccttccccagggttattccttgctgggaaaagaattcagtgatatttctcctacttgcacatctgtctataggctttctgcaagaagaaaaatatggctgtattctgctcgaccccacaggtagtcaaaccttatggttatctttccttgttccctgcaaattgctgttattctgttttttttttttttgcaaggtgcactgatttcatattgttcaaacacccatgttttacaatcacatttaatattgttcaaacacacatgttctgcaatccatttgtacactagtggtcctgaggtgacatacattctcagtttacgaagataacaggattaagagattaaagtaaagacaggcataagaaattataagagtattattagggaagtgataaatgtccatgaaatcttcacaatttatgttcagagatggcagtaaagacaggcataagaaattataaaagtattcattttgggaactgataaatgtccatgaaatcttcacaatttatgttcttctgcttcggctccagctggtccctccattaggggtccataacttcccacaacaagaagcaatggactaaaactataccctagaacaaatggacttaacagatatttgtaaaacattcttcttatcagcacatggaacattctccaagttataccatatggtaggccacaaaacaagtttcaataaatttaagaaaaccagcatccaattgagtatcttctcagaccacagtggaataaaactgtaaatcaactccaaaaggaacccccaaaactatacaaatatatggaaattaaataatctgctcttgagtgatttttgggttagcaatgaattcaatgtggaaattaaaaaattatttgaaattagtaatagtagtgacacaacttatcaaaacctctgggatacagcaaaagcagttctaagagaaaggttcatagcattgaatgcctacatcaagaagtctgaaaggcacaaataaacaatctaaggttgcacctcaaggaactagagaaacaggagaaaactgaacccaaacacagcagaagaaaagaaataacaaaggtcagagcagaactaaatgaaattgaaacaaacaaacaaaatacaaaagataaatgaaataaaaagctggttctttgaaacaataaacaaaattgatagactgttagtgagattaaccaagaaaagaagagagaatattgaaataacttcaaatagaaatgaaatgggagatattacaactggtaccacagaaatacagaggatcattcaagactactatgaacacatacacacattcaaactagaaaatctagaggagatggataaattcctgaaaatataccactctcctagattaaatcaggaaaaaatagaaaccccgaacagaccaatcaataacaagcagagagattaaatcattaatttaaaaatttccaacaaaaaaaatccagaaccagatggattaacagctgcattctattaggcattcaaagaagaattggtaccaatcctactgaaactattccaaaaggtaaagaaagaattctcccgaaatcattctatgaagccagtatcaccctaacaccaaaaccaggaaaagatatatcagaaaaagaaaactacagaacaatattcctgataaacattcatgcaaaaatcctcaacaaaatactagctaactgaattcatcaatatatcaaaaagataatccaccatgatgaggtgggttttataccagaaatgcagggatggtttaacatacactagtcaataaatgtgatgcattacataaacagaattaaaaacaaaaatcatatgatcatcacaatagacacagaaaaagcatttgataaaatccagcatccctttatcataaaaaccctttgtgatagaaaggacataccacaaagtaataaaagccatgtatgataaacccacagccaacatcatactgaatagggaaaaattgaaagcattgccgctgagaactggaacaagacaaggttgaataggtattcaacacagtactggtagctctagctagagcaatcagacaagagaaagaaataaagggcatccaaattggaaaagaggaagtcaaactgttgctgtttgctgatgatatgattgtatacctagaaaacccttaagattcatccaaagagcccctaaatctgataaatgaattcaggaaagtctcaggatacaaaatcaatgtatacaaatcagtagcactgctatacaccaacagtgaccaagctgagaatcaaataaagaactaaatcccttttacaacagctacaaacaaacaaacaaacaaacaccaccaccaacaaaaaacccttaggaatatacttaaccaaggaggtgaaagatctctaaaaggaaaactacaaaacactactgagagaaatcatagatgatgcaaacaaatggaaacatcctgtgctcatggatgggtagaatcaatattgtgaaaatgaccatactactcaaagaaatctacagattcaactcaattctcatctaaatgccatcatcattcttcacagaactagaaaaaacaatcctaaaattcatttggaaccaaaaaacctgcatagccaaagcaatactaagtaaaaagaacaaatctggaggcatcacatcacctgacttcaaattatactacaaggctatagttacccaaacagcatgatactggtataaaaataggcatgtaagctgggcacagtggctcacgcctgaaatcccagcactttgggaggtcaaagtgggtggatcacttgaggtcaggagtttgataccagcctggccaacatggtgaaaccttgtctctactaaaaacacaagttagccgggtgtggtggcaggcccccgtagtcccagctactagggaggctgtggcaggcccccgtagtcccagctactagggaggctgtggcaggagaattgcttgaacccaggaggcggaggttgcagtgagccaaggttgcgccactgcactccagcatgggctacagagcgagaccctgtctcaacaaacaaacaaacaaacaaaaataggcatgtagatcaatggagcagaatagagaatccagaaataaagccaaacacagccaactgatcttcaacaaagcatacgaaaaacaaaaacacaaactggggaaagaacaccctattcaataaatggtgctgggaaatctgccaagccatatgtagaagaataaaactggaacctcatctctcatcttatacaaaattcaactcaagatggatcaaccagtctggccaacatggtgaaactgtgtatccactaaaaatataaaaattacctgggcatggtggtgtgtgcctgtagtcctatctacttgggaggctgaggcaggagaatctcttgaacctgggaagcagaggctgcagtgagccaagatcacgccattgcactccagccagacagagtgagactctgtttcaaaaaaaaaaaaaaaaaaaaagatggatcgaagacttaaatctaagacctgaaaccataaaaattctagaagataacatcagaaaaactgttctagatattggcttaggctaagaattcatgactaaaaccccaaaagcaaatgcaatgaaaaccgaaataaataaatgggtcctaattaaactaaaaagcttctgcacggcaaaagaaataatcagcagagtaaacagaccacccatagcatggaaaaaaattttcctttgcatctgacaaaggactaatattcagaatcacaaggaattcaaacaaattagcaagaaaaaaaacaaataattgcatcaaaaagtgggcaagagacatgaatagcgaattctcaaaagaaaatatacaaacagccaccaaacatatgaaaaaatgctcgacatcactaattatcagggaactgcaaattaaaaccacaatgagataccaccttactcatgcaagaatggccataattaaaaagtcaaaaaataatagatgttggagtggacgtggtgaaaagggaacacctttacactgctggtgggaatgtaaatagtacaaccactatggaaaacagtatggagcttccttaaaaaactaaaagtagaactaccatttgatccagatatcctgctactgggtatctacctaaaggaaaataagtcattgtatgaaaaagacacatgcacatgcatgtttatagcagcacaatttgcaattgcaaggatataaaaccaacctatgtgcccatcaaccaacgagtggataaagaacatgtggtacatatgtaccatggaatattattcagtcataaaaaggaataaaataatctcttttgcagaaacatggatggagctggaagccattattctaagtagggtaacttgggaatggaaaatcaaatattgtatgttctcacttataagtgtgagctaagctataaggatgcaaaggcgtaagaatgatgtaatggactttggggattcagggggtaagattaggagaggggtgtgggataaaagactacatattgggtacagtgtacactgcttgcgtgatggatgcaccaaaatctcataaatcatcactaaagaacttatccatgtaagcaaaaacaacccatactcccagaactattgaaataaatgacaacaaatgattctgccaatctgtatcttctatgtggagtattatttaatccatttacactcaaagttagtcttgatatgggaagttttttctgttatattgtgaattgttttcaagttgttttataaattatttctcctatttctgtttttgactttatgatttgatgaaattctattgtgttgccgtttgagtcctttttttttttttttttttttgagatggagtctcactctgttacctaggctggagtgcagtggtgtgatcttggctcactgcaaactctgcctcctgggtataagcaattctcttgcctcagccttccacgtagctgggattacagatgtgtgtcaccacacctagctaattttttttgtatttttagtagagactgggtttcgccatgttggccaggcttatcttgaactcctgacctcaagtgatccgcccgcctcagcctcccaaaattctgggattacaggtgtgaaccaccatggctggctggtttttttttgtttttttttttttttgagatagggtctcatgctgtcacccaggctggagtgcagttgtatgatcatggctcactatagcctcaacctcccaggctcaagccatccttccacctcagcctcccaagtagctgggactacaggtgtgtgtcactatgccaggctaatttttttattttttgtcatgttgcctgagctggtctcaaacttctgagctcaagtgattcacccaccttggcctcccaaagtgctgaaattacatgagtgcactactgtgcctagcctaattcctttcacttcctcctttgtgtgattgtttttataagatctatgagttttatatttccatgtgttttcatgatggtgaatattgacctttcatttttatgtttaagacccctttcaacattttgtgtaggaccagtctagtggtgacaaatttccttagcatttgcttgtctgcagaagactttatttttccttaatttatgaagcttattctggcaggatgtaaaattcttgactaataggtgtttttattttttccccagcactttgaaaataccatctcattctcttctagcctgtaaagattttactgaaaagtctattgttagtctgatgtgattcccttttataggtaattagccacttttctctcactaattttaaaattctttctttcactttcactttagatattctgaatataatacactgaggtaaagttcttttttcaaaggggatttgcctggggattgctgagtcttctgtatctggatgtgtgactctcttgctcaacttgggaagttctcatcaattacttccttaaataggttttctaaactttttttttaaatctctcttctctctttggaatagagataattcataactttgggtcactttatgtagccccactctctcagaggctttgctcattcttttttattctttttccttacttttgcctgactggattatttcaaaagacatgtctttaagttctgagagtctttcttctttcttctgcttggtttatggtactgttggagctttctaatgcactttgtatttctctcagtaaattttttattttcagaatttttaaaaaatgatatctgtctccttggtaaatttttcattcatatactcaattgattttctgatttctttgcattcattttcagatttctcttgcatctcatagaacttctttaaaattaatattttgagtttttatctggcttttcaaggaatcctttttgattgggatctatgactacaattgttgtggtccttactttttcatgtttcctgtgtccttccactaatatctgaatatctgttgtagtagttgcctgttccaattttttgaaattgcttttgcaggggaggattttttttctgcagatgtatatatgttggtggttgagtaggatactttggctttgattttagatgcctgtggtggtttgatctttgtttgacttcttggcaggaaaaagggtcaatagtacctgtgattttctcagtatcttagagtacagttattagttgaggttgtggtaatgttttgctggggacctggacaccaactgagtcagtctttgggccccagtggtggcagcagttgcctgagtgtgcttgtttttaaaccccagagcagcttaccttggctcttgtgttagtgggccctggagggttgattctttggcctccacgtggcttgtttagaagttagtagtgggaacagtgggctgggtgtgtaagcaggttctcagacccctgggcagcttgtgtggtgtgctttatggcagtagcagtggtggagcaaccaacccacttagacccagttagtccatgttggtgttgctggtggctgccatggattggttgaaatagttctcagtcccccagctgcctgtagcagggtagtgggtattgtcctaagtatgcttaggagagcttggtccatcttgttcctcttctggctgggtggcagctgcagctgtgtcaccttcaacttggcctgagggcaggcacagcccagaattaaactctcaaattgatgccttggccttgagactagagaggttggggcccctcccaggcaagcagcatgaacaagaagctgtggcgggtgcagtctgttcatgtctcaatctcaacagcaggctgcacagagtggtaggcattttctcatggggtacgtgggagtgcctgatctcgcctctccctccttgaagaagtgcaacagcagcagccatgtctgtagatctgtggtatctagcttctcaaaatggtgtccagctgaagctgctctaggcttggatgtctgtggaactctgtgtgtgttcccttcctggcgcaatgcctctgtgcaatctctaggcagctctctatgtcaggcctgaggccctgatgggttggaggattctcccatagccaagattgtaatagtctgttttggagtgtgaagccctgggggttactctcttactgtttccccacatccaggagcctctcccagctctcagctagtcccttgcctggcaagctgccttgaaccctctcctcacttacttctggtgattcccatcacttctctggtgaatcctagtattctctcctagatgatctgtttgaaatgtgagtatctactttactatcctggttctgctctatggacaaagacctatgtctagtcagtcgtcttgatcacactaccctcattgtttttgtttgcatttcccagatgatatatgatatgaagcatcttttcatatgcttatttgccatttgtatgttttcttatttgcgatctgtatatcttgtgtctgttgagggcttcagcccattttgtagttgggttgtttccttatttttgagttttaagggttattttaatattttagataacagtcctttatcaaatatgacctttgcaggtatattctcccagtttgtggattgtctttgaattctcttgacagagcttttgcagaacagaaaagtttaattttaataaagtccatcttatcaattcttcatttcatggattgtgtctttggtgttatatctaaaaagtcatcaccaaacgctagatcatctagattttattctatgttatgatctaggagttttataggttcacattttatatttaggtctgtgaattagtttttgtgaaaactgtaaggtctgtgtctagttgatgttcagttattctaatatcatttgttaaaaagacattcttcacctttgctcctttgtcaaacattagttgatctatatttatgtggctctatttcttgctccctagtctgtttcattgatctattctttcaccaataccacactgtcttaattactgtagctttatattaagttatgaagttgggtagtgtcagtcctccaactttgttcttctcattcaatgttgtgttggatattctgggtcttttgcctctccgtgtaaatcttagaatccaattgccaatatccacaaaataacttgctgtggttttgattggggttatactgaatctatagatcaagttgggaagaactcacatcttgacaatagtgagtattcccatccatgaacacagaatatctctccacttacttagttctttttttatttctttcatcagagttttgtggttttcctcatctagatcttgtacaaatacttatacctaagtatttcattcattggatgataatgtgaataatgtattaggtttttaatttcaaatttttcttgttcattggtggtagataagaaagcaattgacttttgtacaagattaaccttgtatcctgaaactttgctataactggtcatcctgagttttattcttttgcctactttatttcttgacaagaggatttttttttttctcgctgctttgtgtgtcttgttatttttaatggaatgctgaacattatgggtaaaataacattagaaactaagttaaatagtgactaatgtccagaatgggcatatctcttcttctgtcaaacttttagtatggggagttgggtcagttgactcagttcttgagctgagtttcttttattgttgttgctattattacatttagtgcactacaattgtttagtataaattctgaagtcctgtagagtttttctcttgtcgtttgccccatcctcaactttcaccatgccttttttcctcttttgccctcttccactgaaagattgtcactgcttattactcagtgcaaagcttatggtactcagtacaaggcttatggtagacattttttgaatctcttgctccagcttcattcttaggcagaccttgtgcacctaagcctcaggagttgggctttctccgtattcctcctccttctagttgcaggtagccttggcacctactcagttcaggattgagtgcagtgcatttactgactgttataggctgaattgtgtcactctccactcccctaattcgtatgttgaggtctcaacccccagtacctcagaatatgactgtgtttggatatatggtctttaaagaggtgattaagttaaaatgaggccattagtgtttgggccccaattcaatatgactagtatccttataagaagagattgggacacagacatgcacagagggacaaccatttgaagtcgcagcaggagggcagccatttgtgagccaaggagggaggcttcagaggaaagcaaccctactaggaccttgatcttggacttcaagcattcaggactgtgagaaaataaattccagttgtttatgccgcccagtctgtggtattttgtaatggcagcccagaaaactaatataataactttttctcctgtggcagatgaactctaccttgtatcagtgggggatattgggtatgagtgaatttccagtctctcccctggcagcttttgcttagtgtcaaaacagaggcacaagtaagtttcttcttacccttccccggccagtaggcagctttcattccatatcagagaagactctggggtgtgagtgggtttcatgcttatcctctaggctaattattaccttgtactcatagagcgcccagaaatgaatgagcttctctggatactcctgctattttctcaaaccttggcaggctcagaactcccacaccactgaggagggtctctcaggtcttctacctgtccccagtgtttctcatgagtacccaattaaggctcatggagaagaactatgaagtgggtgtggtcttctttcatgtctgtgtctcccagggattcaacacttcatgccagcagacatttaacctttaagaattcatgaatgtttcagttttttctttttacctgcctttatagcttccacctctttttctcatgctctgccaaaattaaaattattcatgagtccctcagttcaactagttctctaatgacctcatcactctgataagatttttttttaaaatcactttttagattacagttaattcttgaacagtgtgggtttgaactgcacaggggcacttagacatggattttctcctgcctccatcacccctgagacaagcaagaccaatgcctcctcttcctccttctcagcctacttgtattagcccattttcgtactgctatgaagaaatatccaagactggatgatttatgaagaaaaagaggtttaatggactcacagttccacgtggctggagagagcttacaatcatggtggaaggtgaaggaggagcaaagccatgtcgtacatggaggcaggcaagagagtgtgtgcaggggaacttccctttataaagccatcggatctcgtgagacttattcgctatcacgagaagagcattggaaaaacccacccccatgattcaattacctcctatcaggtcactcctacaacatatggggattatgggaattacaattcaagatgagatttgggtggggacacaaccaaaccatatcactactcaatatgaagatgatgaagataaagacctttatgatgatccacttccacttaataaatagtaaatatgtttctctttttatgattttcttaataacatttttttctctagctactttattgtaagaatacagtatataatacatataatacagaaaatatctgttaattggctatactattcataaggcttccagtcaatagaaggctgttattagttaagttctggctgagtcaaaagtgatacataaattttcaactgcatggtggggtcaacattactaaacccctcacccttcatgggtgaactgtatttttatatctatatctaatctatatatctatatatctctctatatatatttagtttgggtggcctcagcttccttttttttttctttgtatattctaagtggatgcttgaagtcatttcatttattgacattgtcagaatcaaaatgtggtgatatgaaatcagtcagggccaaagttgttgtactcagaaacgtagtataaatcatgcaaacactatataaagcacatttcaaatgaatcaggtatttaaaacttgctatggtattctcccatcaaaacttttagtgactgttttaatatttaatgggctggacatttgaaggcaattattgttcagtgaatttagtagataatcaaagtctaattggttacttttgtatttttttcttttttttgagacagagtctcgctctgttgccaggctggagtgcagtggcacgagcttggctcactgcaacccctgcctcccgggttcaagtgattctcctacctcagcctcctgagtagctgggattgcaggcatgcgccaccacgcccagctaatttttgtatttttagtagagacagggtttcaccatgttggtcaggatagtctcgatctcttgaccttgtgatccatctgcctcggcctcccataatgctgggattacaggcgtgagccaccgcccctggccacttttgtatttttaaatccaatattaaagtaaactttatctggaattctaactgtaattatctcccactaatatgagaacaatctctttaggactggaaaccacgaagtcaattgaattgaatgcaccacaacccagtgagttaaatctttgtggaaagattccacaaatgcctctaaagttgcatctataagcttaatgatcttatgtctgtgtctccatggatgccaagtgatatgatttggatctctatccccacccaaatctcatgttcagttgtaatccgccatgtcagaggcagggcctggtgggaggtgattggatcatagaggtggaaccttaatgaatggtttagcaccattcatctctttggtgctgttcttatgatagagttctcatgagatctggttgtttaaaagcatgtggcacctccctgctctctctcttcctcctgctcctgccatgtgaagtgccagctctccctttgccttacaccatgattgtaagttccctggggcctccctagaagctgatgccacaatgcttcctgtacagcctgcagaactgtaagccaattaaaccccttttctttaccaattacccagtctcaggtatttctttgtagcaatgtgagaatgaactaatacatcaagtaatgtggcaatactggttaaatgtcctgggaatgatgagagagcagaagtggtagtgattcacaagatagataccacatggaagggcctgaaagccaaactgagaggtttggacatgaacggttcttattgattgacggattgattgatttcctattaagggaataacatgatacagagaaacgtgttataaggaaactactattgagatctcaaatccatgtgacttggattttagtcctgattttactgatacaaagcacagtgaggtgaaaagagctaactctaggtccagacaagactgagtataaatctttggttctgccaattaagattttgtgactttgagttatataagccttaagagctgtaacttacttattagctaaatgacataattgtacctaccttgcagcactctggagagaacataagatcatatatttccatagtgcttggaattcatcattagaactccataaataattgacattgggatgattccaattgtaaaaatcatcctctctgagcctcattttccttgtgtgtaaaatgggatggtaacacatttcattgagccattgatcagattaaaagacatgatgtattatatgaaaaacttcctagaatgcaaaatcaaatgttattttttcttcttacaaaagttgttattcaaggattattagcagccaccattaattaggcacttcattatactgttttacttacctcatactcacccaattattgaagcagggattcctgccctaggattatagggatggccgacacttgacacttgacactgaacagatgagattgacagcagcttgtcagtcacacatactgcactcacatccagggaaggaggacaccacgtggtaggtagcacttatgctttggagcagagtaaactagcagggattgtatgtagaaggcaggctttgtagtatcacaaggctgtggtgctccttggttcctgtgggaggatgtgattggctcgtttgaataattttgtggactgacacagaatgaaaacccgctactaagagataagcaggcaccacacctggtccctttgaaaagaaggcttctttggcagggagtccttatctgctatagcagcgtagggaggggaacttgtggttatgccatttgaggtcctcccagcttctcccagatgtcaaggcaacatataacattggggttttaaatttaggtcttctgtcacacatattccaagaaatttataagtctttaaaatcttcattagccctccaaggtagatgctgtggtctgaacgtttatgtctccctaaaattcatatgttgaattcctaacccccaaggtgagagtgttgggaggtggagccttttagtctcctggctgggattagtggcctgataacatagactccagagagctggcttattccttccactatgtgaggacacagcaagaagccgctgtctgtggggaaacagaggcttactagacatggaatctgtcagagccttgatcttgtacttcccagactctagaactgtaaataatacatttctgctatttataaaccacccggtatatagtaatttgttatagtagcagggacaaatgaagatggtggatattattattattattctcctcattttatagatgaggaaactgaggtggaaaggacaagccacatagcaagtggcagtgccaaggatgagctcaagtttgagttctggtgaggtggctgggatcatgctggaatctgatggcgttatgaaggatgatgctgtagccatgtgagactcaaggcaggaggcccatcagagcagtcccggggtgcaggggtgtggcaatgaacgcccaccagacatcacgagctcaaacgtccaggctcgacacagcacatgtaaacaaatacacatagacagggaggcaaggctcaggactgaggacaaactagggagtggtggggaccacagtgaacccatggcgcatgctctttcccagaggcaggtcgctcctcagatccagctgactgtgccagatgtgaaagcaagatgggcatcacagttcttgtgatgtttagagaagagctggaaaactgaacttaaatgtgaagtagctattttaaaggctggccacaattataataaaaaatatatatgatataggccacattgtgagtatgaagcaaactgtgtctgtaggttgggtctggctctcaggctctgagcttcaggggtggaaatggagacagagggactgcctgaggcactgctgcagctgtgggcctggaatttaaccagaggtgttttttgctggagggctaagtggcagactccagagcattttcctttcagcgtgagaccattcatgatgtatgccctgggcttcaggcttcaccagtctggaggtacctctgtgttcacactgatatcaatacctgacttgcttcatacttcttcctgcctccgctagcctccacccagggaaggtgtgcttctcggtaagtcagtttgagagaagcagtgtagtgtagtggtgaatagtctggatttacatctttgatcttccatttactacgcttgtgacctagggggtgttgcttcccctctctgttccaattatttatccataaaatagaaataataatttgacctcgcttcaggggtggctgcaagaattataaaagataataaacattgaggacttggaaaaaatctctgcatgtaataaatgttctataaatgtcagctgtcatcattcacacttctttctttcttcctgatgcattgatttgaagcatctgtctgctgcctctgatgcatcaacttctgggaaaattcacttggtattgcccagagccctcaggatgccaaggctgcataatacatattcataatttcataatattaataatattcattcagaaaatatttatcaagggccagctgtgtgccaggttttgttctaggcattggggaatcatcagctgcaaacaacatagagaaagagtttatattagaatgtccaagactgacaatgataatgaagccacataaatgaacaaaatcattcctgagtgcttaacgctctgaagaaaaagaaaatggcggtgtgatcacaaatgaatagacagtgactttaggtgctcaagaaaggcctctgtgaagaggtgtcatttgactggaggcatgaataataagaaagtatcttttcatttaaagatctgggggaagagtgttccaggctaatggaacagcaagtgcaaaggccatgaggcaggaatgagctcggcttgtccagggaacaagcaaaagattacagtggctggagtatagagaatgaagggatgagggccagggaggggccactgagctagctgggaccacatcacacaggcaaaggctttggttacatcttaagtcctaagctgaagatttgaagcaggggaatgagaagacctgatttacattttatatttatatttatattttgaattgatcactcttgctgcagtggaggttggatttgtcaacaggagggcaagcagagaggccatcagctccaatgtggactactgtggaataggtattgggggaggcagggagaatggctcttctccagataattttttcattcactgatttattcatccaacagctctttcttgtgtgtcttagcatgtgcctagtatggagaatgctttgtcagattcgattcacgatgtgtcagcaatgtgttgggcactgggaatacactgacccatgacgttgtcatgagctctgagctctgctgtcttggagctttcaatcaaacatccctcttggtttcctgggtcctgaggcagctctgtgtgtacgtcatctttcatgaacatttatcctatagcagcttaccccaaccacactcactttcacgtgggctcacaaccagggcgatggagggatcgaggagcctccatcttagttgcccttctcttttcttttctctcttcttcctaggccccttccgtataactccccacctccctcagtaaaatattagagatgtaaatggggaatgcaaaatgcatatggagcaggaaagaggcatctgaacgtccctgccaaaagcacagaatctcactgaactctgtgtacacatttgtgtacacagagcgggtgaatgtatgggggattgggggtgagtctacctctaggtgacccttgagagaataaaggcaatatttatttctgatctgttttcaataaggtcagactctttttttaatttttaatttttttttttgaaatggagtttcactctcattgcccaggctggagtgcaatggcgcgatctcagctcactgcaacctccacctcccaggttcaagtgattcttctgcctcagcctcccgagtagctgggattacagacatgcgccaccaggcccctctaattttgtatttttagtagagacggggtttctccatgttggtcaggctggtctcaaactcccgaccgacctccggtgatccgtctgccttggcctcccaaagtgctgggattacaggtgggagccaccgcgccctgcctttttgtttttttaagataatttttttaaggtagtgaaacaatattacttactatgtggaattctttgtcagattcaattcactaccacaggttcttgcgtgaaatcctgggtgtaaccaaatttctcaaatagtaaagaaaatgggcaatccattttcttcaaatgaaaccaaatacctaataaccgtctttcactatctgatagtcggaggctggtgaaaagatcttcgaagagagtctgacaggtgggctaaactcctctaccgcttctttacagaaaagaaatgtcagtcatactttttaaaatagaggggcttcaaattgcaaggaagtaacaaggagtggaacaatgactttgcaggttctatgtgtcaggtacttctcatttggagtgaacaaagatagaagaattctggcaaaagaaaaagtgaaaaaatcaatttaagaaaaaattttcatggcaatggaatccatttttcaggatattattcagagatccaatatgcaaaagagagaaaatagaaactgttttaaaagccggagggtgggatgggcgtggtggctcatgcctgtaatcccagcactttgggaggctgaggcgggtggatcacctgaggtcaggagttcaaggccagcctgaccaaaatggtgaaaccccatctctactaaaaatacaaaaattagctgggtgtggtggcaggcgtctgtaatcccagctactcatgaggctgagggaggagaatggcttgaacctgggaggtggaggttgcagtgagctgagatcatgccattgcactccagcctgggcaacgagagtgaaacttcatctcaaaaaaaaaaaaaaaaaaaaaaaaagggagggtaattagggctcatcctgttgtcatccagcccatcccaggtaagttctggagctttagttctttgatgcacgtagttgggaccctattgatttaaaccatgatagagagcaaagattgtgggaatcctttttttttctaagctaaattttatttagaatatatcatatggtaggactctttgctaacaaagccatttacattcacagcattatgttcaatcccatgaaataggtgttgttatacctgttgtccagatgaggaaactgaggcaccaggtggctagatcatgtgcccaaagctacaccgttgctaagggcaaatcttggtgtcacactcagagctgccaccaaagttcttgctttgaactttgaactctactttctctctctctttgacaggctcttcaattcttatcaaaagtagaagggttttaggaatgcttacagaaatgagacggggaggagaaaaaggaggaagaaagagtaatgtggaggaggcagaggcagagggaagggtaggtcttaagctagtgacaaagaggaaattagtgtaaagtgataaaaacccaagaaccaaatgctagaaaggaaactccatggaaaatccaaagaaagataatatcatgaggagagaagagaagaaagaggcgggcccagatggaaggtcactgcttactagagaccaaaatgccaagatttcaacgggagccagccaccctggtttctattttgatgtgattacttagtcatttaaagtcaggttaatgttggccaacaacagatggggtcaggacacaggagttctgcagctcactgaaactggacagtcttttagggcacccagctcacaaggccacaccgtggcccgcccctggatggtggctttttatgccatcaaatgatcattttacccccattgactgaagttttagctaggttgctaaaatgacagaccaggttggagtccatgaaccaacagctgtcagatccaagggacaagctagaggccaataatcgggctgaaggaatgtttcgtttgccaaaagaaaaagcagggaaaaaaaccagtaagcaagctgttggcatatgtgtgatgactggtctctgttagctcatttgtgtggaattaattaccaagatgagtggtatcaagaccatgcacctccactgcccaagttttgggtgggtttggtgacatagctccaactgccattatgggctaagtgggtgcctgctggatggaggcgcctgcccaagtgatgaaggacaggtaactttctctgcctcggctcacctctctggaacaccctgatcatatatgctccttacctagtttattaggtaagggctgtggaatcatgaggcaagagtgttggagagagcatgttgagtcttctgggaaggaaaggactgagacattctttaaagaccactgtttaaaggacaggaatattctttaaaaataagagaaggcaattcacatgctttctctgatcaggttctccccaactctaggctgggcagtattaaccccattctataggagatattcagagatttctgagattcagagacattatgttgtttgttcaacttttatttttgtttatttatttttgtatctccttctcctttaggtgccctgaacctcttgagtgcatctattgttaatccctttagattcttagccctaaccaaagggtaccaggataggtaccaaaggctggactcgagacccggcagggtcactttggaaaccaagcagataacataactattagaggcagtcaggtatagagtaactggatgaggagcatgattagagggaaagtgcatataaagactttcagattcaaagaaaacacaactacattggtaaacaaaatacataaagccagagctttccagtttacagcctcctggctagatcatccttcaggtctttttgagttctaacgtttaatttttaaattttttttgccatacataaaaatgagcacatcccttgcttattcccttcaggttctgctttctattggcaggagtaggcgatggtggcaatgagctaatcagataagctaacctctgctaatgggtaaattagctaatgggcaattcctcttgtgacttaatgctatcattgggttaaagcatatcccttctgatcttggacccacgggattgacaaatgatgggaattcagcatccctgcaactacaccctaggggcagtttcttggtcttctcaatgccaggggcagggctggacagaactggcaagtgagccagcctcaattccctttaatagtggcatcaatatgatggccagaacctaattattgggctaaacactatggagttctgtatcatgtggtggccccatgaagggggtggggatgtgaaaacccaggcaatcttaaagtgatttatgaatattttgtttaatcacattttaaactctgaataaacacataaatacttttattttatttttcatttgtttttgtgtgtttgtttattttttaaagaggggtcttactctggcacccaagctggagtgcagtggcatgatcacggctcaccgcatccttagtccctgggcttaagtgatccttccacctcagccttctgagtagctaggactacaggcccagctggttttttaaaaaatgttttgtagagacaaggttttgctcagttgcctaggctggtcttgaactcttgggctcaaaagatcctaccacctcggcctcccaaagtgctgggattacaggtgtgagccactgcaccctgcctataagtacttttttttttttttttttcgcggagtctcgctctgtcaccaggctggagggcagtggtgtgatctcagctcacggcaacccctgcctcccgggttcaagcgattctcctgcctcagcctcctgagtagctgggactgtaggcatgcaccaccacgcccagctaatttttgtattttcagtagagacagggtttcaccatgttggccaggatggtctcggtctcttgaccttgtgatcagcccaacttgttaaaaaaatgcattgtggtaaaaacaaaaatatttggaaaggcataaagtttaaaagtcctttttcctcccatctgctcaaactcccaggctcacttccctaaagaaattaagttaatgttttgtaaatatctaagctaaggaagatcacctatagcttgaatattccatctccagaggagccagaaacaagcaaaccaaccaattcatcttagttccctccttccaccatcccagagctacaaattatgtgaacagcatggtctccttctcatgcatctgtcttccattctcttggctttctattttcactgctatggaactccaccctatgcccaccttttcgatttcagaagatgtctttttcagaaaaaaccttttatcagcagcttacacttgagtgtagaaaaagattataatgaatgtagtatttaggatctggaaggaaccttccataattgtggatgcagaggccacctcagaaaaacaaatatacacccattaccttgggtttgtgtaaaggttcagtgtttataagagggctttcctgtccatttttatacttgatcctcttcctggctcctgtatggaagcaggggaaggcagtattatttccactgtgcagaggagaaaactgagcctctgagaagctgacttccccaacagccagtgcactcgtcccgggaccacagcatggaaagcctttcaccctactggcatcagctgcttgtggagggacttcaggtttggtggagacagtgggcatgaggccatcctcagagcgccttaaattgcaacacttgggatgctggctgttttgcataagctgatattgagctcaggctcaggtactctgctgactccactctccagatttgatttggctactggccctgggtttcccaggcatggaaatgacatcaccatggcttgagacagaagaccaagtggagctctggcactcagccagcatgggcccttcccagtcccctgcttcacaggtgggactcactttctttcccttcatgcttttcttcatccttcccttaatttggtgttgttacctctcatataaggggagatgtctgttttcctaacatgacctcctttgcccaggcaggggtagggggagtagaatggcaagaagcggttgatttgagtgactacagtgagcaggtgctgtgctagggacactggtaccgagaccaagagggcagcatattcagtcttgaggacctcacggctcagggaacaggtcatcagacacatagcaaagtaaatgagtgaggaattgcatttggcttcaagtaatagagaatcaaaacaatagagatttaaacaagggtctctttttcttccaaattccttgtaatttggagctgggtggcccagggctggtttgggacctctgtgatgtcaccgggaacccaagttcctttgattcttctgcttggcaatgtttagtaggattgcttcgtggtcataagacagctgttggaaatccacactgcatgtctcaagcaggaggagggaaaaaggcagaaatgcaaaatggtgttagccaagtacaccctctttatttatttatttattttgagacagagtctcgctctgtcacccagcctggagtgcaatgacgccatctcagctcactgcaacctccacctcccgggtccaagcgattctcctgcttcagcctccccagtaactggggttacaggtgcccaccaccacgcccagctaattttttgtatttctagtagagacagtgtttcaccacgttagccaggctggtctcaaactcctgacctcaggtgatccacctgccttggcctcccaaactgttgggattacaggcatgagccatggtgcctggccagagtacaccctctttaaattgctttcctagggcccctatcccatgatgttgacttacgtttcattgcctgccctatctccaaaggaggataggagataatttgtttagcctttattttttcttttttaaactgggcacattgtcatctctaacaatatagtcttgttattatgaaagaggagaagaagggatgttgggtaaattactagctgtgtcacctaatctgggcaatttcagtgcattgtggtggtgtactttgctgaatgtgtgatttagcaaaataattaaacctctctcatcttcaaaatggatatactaataacacataccttatagtgactaaattgcgtaggattactgtgaagattcgatgagaaaatgtatgtcaagggcttagggctatgggaggtatgctgtaagtgcccaataaatgttagttgtgatggtgagcatgggagagggtgatgatcctgggtttgtattcccctccagcactccttgcctggctatgggcacagccctgtgatttggtttcttcaatgataaaacagtaggatgtgtctctaaattgctatgagattgagataatccctggggagtgtgtaacagagtgtgcagcatgtcctaggaactcggagaattatgattatgaaagcaccgagaagaggcgggacggtcagggaaggcttcctgggtgaggcgtctctgggttatgtttcacaggtgtaaaggagacagcctgggaaggaggtggggaaggctgtcacatggtgtgctctgggagctgtgaagggtctggggcatctgggccccaaggtcaaggtaggacatggcactagttgaggcagagaggaaggcagtgtttggggccatgctgaggggctgagagccctgggggtgtggagcctgctgctctgatctcctgggactggtttctgaggctgaagagatcattattcacagacaaggaattaggtgctttgaacaatgcttattttattggcatctgcaaactgccacctgttaaccagaagcctgggctcaaactctggctagattcctctgggaataggctattaatcaacgaatgacttcctctttggcagagaaggaaatgtctaatagcttgaggctgatcttatgactggaaaaatggaaaggctgttgtaagttctcacagggatgtaaagacaagttgtctgtaggtttccaacagggttttttattacctattagcaaatgagcacagatttgtttatcagcttcccctagaaattaggttgttgaggcagctggagaggtgaatcctggggtgggagaaggcagagaagggaacaagaggagctggcattaccttggtgcattgtacttaaggaaccatagaggtggcttgttcctgagctggggttgcatagagagagcactggacatgagtccaaagtcacaggggccagtctcacctttgccctgagttcccaaaaacaatgtacgctgttctgtaaaacatggataataccatggccacttgggattaccaggctctctgatggtaacctaggaaaatgtatgtctgcgaagacactttgtaaagtgcaactagagtaaaatccaacccccgccccaatctcccaggccttctgacaaattacagagcaccccaggctctctttccactttgtacattgaccattgctcctttttctgcctagatcattcttctgccccctccttggaagggccttccatgcctttctaagtatatgctccccaacatagacagtggttaagacccaggctctgaaacaccactcacgggttcaagttcggctctgatacataccagtgaattgaccttgggcaatcacctgacttctctgccacagttcccacttccgtaagatggaagtaataattgtttgtaccttacggagcagttgtggagaaaggatgacattaatagttggccattattactgtttttcagagcactctatttcccttctagcgctgcggtctgtaattaatttatttgtatatatgtccattaaccaccacccgtaatatcctattatcttctataatgggatcttttaataagggcaatgaccatgtctttctcatcatccttatatagcacagtgcctgcgacttaaaaaatgctcaagtcatagttgttggatgaggaattcactgaacgggtatttcccagaagtctcaacagcctgtccccagagacaagaaggcaccacgaggggtgactgaggcagccctgcagcccctcagggaagagccagggagcttgtcagatggccctgttttgcatttcattctcccggttgcaggctttcacttatgtaatgaaatagcagtgaaaccccactgacacctgagtgcttcccctctagccagcccagtatttgaccacaaaaagggggaagaaaaaaatataagaaaaaaaggagcttcaaaccacatgcttcttgggacacacagatgagctgtcctttccccagagtcgtctgagcgtattgtagtagcctggaggggtgttttgctgagcctgatcattgtgaccaagtggtgaaaaatcaaggtccccagcctgcgtgtcagcagtcgagactttttccacctctgcccctgacctgctgtgcaaccttttgcaagtcaccttacctgtctgggtctcttcagtgaccccatctgcaaattgagggactgaaatagatgatgaaagtagagtagccatgcagttctggctttgcctgtagacttggtagaatgattaataataacctctttcattcttcttttttttgagatggagtcttgttctatcgcccaggctggagtgcagtggtgtgatattggctcactgcaacctccacctcccaggttcaagcgattctcctgcctcagcctcccaagtagctgggattacaggcatgtgccaccatgccaggctaatttttgtatttttagtagaaatggggttttgcatgttggccaggctggtcttgaactcctgacctcaagtgatttacccacctcgacctcccaaagtgctgggattacaggcataagccactgtgcctggcccatttctctaaatgacttgtattggatgatggattataagattagttggatgcaagtctctgccagttgtaagattattgctcttattattattattattttttctgactgcccatccgtgctcctactctatccccagattcatgctctgtccagcttgctgtctggaatgctgacctccaaagccactgtcacttggccactcctactctccggattcctgtgaggtttggtgatggaaggcactagcagaagaagggattgtgggaaaagagagaagcagggtcattaatccctcagtgccccctttactgcatcctgggaagtgtctgtttcctgtgcccacggcttccattggctgagctctagaaaccttacaatttcccagccctttaggcctaggggtagtaatgtcttctcagtgtgcgcttccatccccagccgctccctagttctaccacacctctgaatttagtgccttcagcaaactgtctccggttgactgttttgaggatgcttcttgttttctgctagaacttggacaaatacagattctttgacactctgacccaatcttcctttgaggcactgggctgtccagtacagggacaccacatccaaatgtaggcagctctgctgctgaatcttggttttctaggatgcaagggtcctgtggcataactggcagcatgaattggcggggggtcacgacaatgggctgtgatgccatttaggtgctattgcagcaacatgaacatgaactcaagaaactcacagtgcatgtctgatgcatggtaggcattcgagaatagtaagatttctacccccagattttattatgaacatttttgaacaatcagaaagttgaaagacttgcaccatgaacacccatctatttgtcgtctcaactctacaatgaatacttttctgtccttgctttatcacatattcatctatctaatcctctatccatctctcaacccatcctattgtttatatactgtattttaaagctaattgcaaacatcagtatattccttgtctaaacacttcagcaaatataataggattgttttcattacaaaagcaattgaagctaatagtgaaacattctgacaatacaaggtgtatgaaatgaaaaatggaaaatatctctttactctctgtaatcttgttccccaggcacaactgctggtgggtgttgggactcagaaaacaataccccaaaataaaggcttcagaagccaaaacctttttctctgacctctgccctcctgtctctcagcccctttctaccccaaggctagccagagaaactagaatccctttttcccaaggtagggcataggaaccagaaccccttttctccaaagacagccacaaaacctagaattattatgccagtgttcccctctgcctttctgtgtaaaaattggccatgaagagattagctgacctaccttgtttgacccccattccagagaggggtctgccccattcccagaaggaaggaatgctgctcagagaggccaagaagaacttcgacagacaggccttgctgggtttccctgctcagtctattagcattagattagacctttttttttttttttccctaatcctatttctacatggctgttcacactttgttgaacctaagcataaaaatggacaatttcccctgtatccttgttcttcatcctgaagtcccctgtgtatgcacattaaataaatttgtatgccttttctccaattaacctgcctttcgcgagttggtatttcagcaaatcctcagagggccaaggggagccctccctttcacccgtacatgggatagtcccaagcattcatgtacacctgtagttttgatatcttacaaaacttgaattatagcatacttattgtttcgcaccttgcttttaaaaaatcaaccataccttgaaaacattcttgcttgttaataataatgggtcatctcaactttttaatgactgtagaaatgtccatattatgtacctcatttatttaaccatttctcactgatggacattcatactattttgggttttttggggatatgataaacaacgtcacaatgaagattcttacacattcctttacttgacaaatattctaataagcagcactgtgtgccagacatggttctatgcttggggatattaggaaaataagatgggtaacatttgtgtggaaagtacattcttctgagggagtcagataacgaactagaaaacatcaaaagcaaataaattgtttttagctagttattaagaaaataaaattgagtaatttgatagatggtgatagaaggggttactttacaaatggtcatctggaaggcctccacttcaaggtggtgatatttgagctgagacctgaatgaagagaaggggccagttatgcaaagtcctaaggagaatggatagcaaacgcacaggctctggagtgggagcaagcttggtgtgttgagggatagaaatacacagagcatggcaaatacagcaagtggtgtgaaatggggttggaaaaggtggcgcaggccagatcactaggaccaaggagtttgaaatttattcctagtgcagtatatcaggttgtatttttatcactggataatcatagagtaaaactagcttgatctgatccatgtagaatggaatatgagcaaaaaatgttttgtatctggttagctgcagcatggcaagccacaatttccctctaggctgtgtggcaccctggaaagagaatgggtgtcggagccagagagatctgctttcaaattccagctccattggtatacaccccaaagaattgaaagcagggtctcgtattggtacaccatgttcatagcagcactgttgacaaaatggaatccccaaatggaagcaatccaagtgttcatcgacagaagaatgataaacaaatgtggtatatagggtgagcatgatagcttatgcccataatcccagccgaggctgaggcaggtgaatcgcttgagctcaggagtttcagaccagcctgggcaacatggtgaaaccttgtctctacaaaaaacacaaaaattagctgggtgtggtgatgcatacctatagtcccagctacttgggaggctagatgagaggatcacttgagccaggaggtcgaggctgcagtgagccaagatggtgccattgcactccagcctgggtgaaagagtgagacactgtctcaaaaaaaaaaaaaaaaaagtggtatatgcacaaaatggaatattattcaggcttaaaaacaagggaaattctgacctgctacaacacgaacatgttaagtgaaatatgccagtcactaaaagacaaatactgtatgatttcacttatatgaggtagctagaaaagtcaaattcatagagactgaaagtagaacggtggttagaaggggctgtggggagggaggaatgagtagttgttgtttaatgagtgtagactttcagttttgccagataaaaagagttctggagattggttgcacaataatgtgaatgtacttaacattacttaaatgtatgcttaaagtggctaatggttaagatggtacattttgtgttaagcgtttatgttatgcgcagctaatttttgtactttttatagagacggggttttaccatgttgcctaggctggtcttgaactcctggactcaagcctccaaaaatgctgggattacaggtgtgagccactgcgccaggccctgttacttgtttttaattaaaaaattccagctccatcacttactgatggtgtgacttggtcaattaatccctctaggcatgagttttctcatttataaaaggaagacaatatctcatagctgttctgaaaacagacttcagtgctgtctgcttccaatcttactttgcataatttggaatctcaggctccccaggcacacagcttaaagaacctttcagtgaatcccaattgagttgtccttgtacctagtacatagtagatgctcagtgaacatttgttgacttgctggctgactgaatccacttatgtagatatgatctaaaaggaagcatatgtgtagggagctatgtgcctagtacatagtaggcattccataaatgtttattggacagatgaatgtgtacacacctgaccacaaactgtggcaaaacaacttgcttgctccaaaatgcacacattttttcccccacgttgtaccgtaatggttgctttagaaaacaaactgaaatccctactgactgagtctcatgttagcactgttgctagaaaaaaaaaaaaacaccccagatttccacaagtattgtagtttaaacaatgcaaagttattctcttacagttctgtgggtctgacatggtctcactgggctaaaatcaaggtgtcagcaggggtatgtgccttctgaaagctctaggggaggatctctttccttgcgcattcaggtcgctggcaaaattcatttcctctggttgtaggactgagatgttgtttccttgctggctatcactgagggacattcccagcttctagaggccacccgaattccttgactcacgcccaattctgccatcttcaaagtcagaaactcttctttcctctcacctctctgactcatttttaaggaaactgaccccgtttttaaggactcgtggttggattaggctgtcctgggtaatgcgggataatctcagagtacttaaccttaatctcatttgcacagtcccctttgctatgtcgtaacatattcaaagattctggggattaggtcatggatatatttggaggggttattattctacctattgcagcatccattatcactttagaatggaatggtttctcagaacaggcagttgtctgtctcccagcaaagagctccagaaaactaggccaatgaaagggaaatttggatgaaggcaagagaggtgaggcactggcagtaaatgtgatggcaggcctgcaagggatgctacagaaagaggttcctggtttcatggaatccaggttattaaaagaagaaatattcacaaatgccaggaaagttaaatttcatgtctcttacaatttcccttcagatcagttctgccaaagataaagcgatcttcacctctgtgaaaaacagtaattcctttctccatgatgttcatgatttggttgatgggttattggttcatcgctgcaattataattgaaggacattgtctttgctggtttggtgaagcttccagatgttattagaaggggtgttcctttaagctcacccagcattctctcacttatagctgggcattagctatacaagagctatttggtctctgagagcaaaggttcagccactaaggaaggacctggtgtccaacgtaggcctttagattatttctggagcttgtctccagggcctaagaggtgactctggcaggacaccatctgtttcaaccctattttttttcttctttctgcctcggcaatcctctttttttctttttcttcctttgtctcttctctcctttctagtgttctgatgttttaggatcaaaataatgaaaaagaatagaaaccatttcaactcagaaaataattcaaagatgggaaaaaggtgtgtaccaaattcattgctctaatcatttctgttctgataaaaggagtttacagcaaaggaataacttttctgtgtctctgaggctttggaaaaacaaggcatcaagaagctttggggtgtggtgggtgtggtggggcagcctactgcttgttgaggtaatgcaaactaaggagaaagaggtgttagcttcctccgaggccagggcgttttaggctgcaggtaaaccatggatgtggttctacagatgttgccacaacaggaagacaaaatctcacagctaacagaggtcacagcttttggaaacagtggttgcgacacagaggaaactccccctcccagccctaccccaagcacatccttgcttctctcagtcacgccagttacaccaacaggggcagctctggggaggacatttggaaaatagtcaagagagggtgaaaccgctggcatgatgtcaccaacaagaggctaccccctggggaaacctaacaggaaaaaggtagttgagccaggaaaagccaccagaccctttctcttggcttgaggcatcatatacatttgaataataatcaaattaacaatgtaatatgactgtttagcaacaatgatgtgctaatcatggttttacatggattatctttagtcattaaattctctacatcctagagatgcggaaattgagaatgagagaggttatgagagctttgaaaggccacagagcatgtgttgtggctgagattcaagcccagctttactgattttaaagcttgtcttctctttccctcccttgcttcctttttttttttttcaattttctttcttgcttcatgtgctttttttttaaagaaataaaatgttaccccctcatcgataatccctttgtgtctctgctgtctgccctgtcccacccgcctgccatccttgccagcagcagcctctcaattgaggttagagtttctctcccacccttcattatgcatgttcatggctataaacaatcagtatgcatgttttaaaaatttacgtatatgagaaagagcttaaagtattaatttacggagaaaaaaatacaaatggctattaaccatcagaaaagattcattaaaaaaagagtaataaaaattcaaaccacattgaagctgggtgcagtggtgcattcctgtagccctagctacttaggaggctgaggtgggagggcggcttgaacccaggagttagaggccagcctgggtaacacagtgagactccgtctctaaaaaaaaaaaaaaaaaaaaaaattcactaaaaaaacccccttcacattgagatagcatttcaaaaatctgccaaatcggtccatacccaagatttgataacagtgtatagaagcggctgagggaaagacgcacttaaactttgattgtggtgagtaaactggtataatctctgtagagggcaatttgacaacatataacaaaaatgcaaatgcacaaatctaggtgtggtggctcatgcctatagtcctggtacttttgggaggctgaggtgggaggattgattgaatccaggagtttgagcctgcaatgacctatgattgatccactgcactccagcctcggcaacagagtgagaaactgcctcaaaaaaaaaaaaaaaaaagcaaatggcaaatgcacaaaattataaaagaaatcccatttcttataatttatctatagataagtatatgtttacacatgttcaaaactgcatgtgttcaaggttattcattgcagtattgcttgtaataaaaagaccagaaatagttcacatattcattaacagggagtgattaaataagtatggtgcatcgttgtaacggaatcatatgcagttgtaaatgagaatgaaggcactctctgtactaatatggaaagttttcaaatacatgtgaagtggaaaaaaaagcaagatgcagaagaatatatatagcatgctgtattttgtgctaatgaaggggaaaataagcctatgtattaatttttttttgcatatgcataaagaaactgaaagtttacatgcaaaacctaatagcagttttgcatgtgggatgtggaaagaggggcggtatgaggtatgggagaagatttttaaatatatttcttaattttttttgagatagcccatgtggatggactatgttacctattccaaaaattaaattaaaaagttaaagtggttttatgctgtacaagtgattctgtaaccttttccaatcaggtttattttatttatttatttattttgagacagattctcgctctgtcgcccaggctgcagtgcagtggtgccatctcggctcactgcaagctccgccccccaggttcacgccattctcttgcctcagccttccgagtagctgggactacaggcgcccgcctccacgcccgctaattttctgtatttttagtagagaaggggtttcaccgtgttagccaggatggtctcgatctcctgacctcgtgatccgcccgcctcagcctcccaaaggtttatctttctgaatttttatccgtgtggttgtgcccttgatttttccattaattatgctgccttgaactgtagaattttacagctggaaaagctcttggagaacacctagtttccagcttttatattacaggaaagaaaaatgaaggtgcagcagtggcaagtaattactgagagtagctcagcaagtcaatggcagaattgggggtttggcctcagacctgactctgattcagaggctgggactgcctttcttcaccccatcctcaaccaatgccaaagccatctgccgagtcttaagaagagattggtaactttacatgttatcctttcctaggcacatttgcattcaaaaacaaaacaaagataacaacagacaacaaaacccagtggtcactgttgcaactgattgttcagacctcagaagtcagggagatgctttgggatgagagatatggggtgggatggtaatagtggttgggccggtagtcaaggacacggtaaactttctaatatctccattctcctacaaaatacataaatcagttaaaggaaaagaaaaaggcaaataaaacaaaaaacaaaaaacaaaacagcgaggttatcactagttcattcatataaagattgtttctgttttcagctcaggaagaactaatttgaattttatattagtgatgacattgctatgaatattattaatttaactagatcttattagactttttgttgccatagtgacaatacaggcactaataagccacagagtatgagacctctgcaggcagagtcatctggtgtatctctccgcctacatgcggaactcctctaagccgttctgacgggtaaagaccttttaggatttatgttaataaataatgccagcccttctggagttcttatagtcaagcaccgtgccagaagtggcaagaatacaaagactcagaagaaatgtacttctgagatggccaaattcctaggcagataaaaaggggtccccggagaatctccgactggcctgctcactgggagaacggggtggaaccagggggagttcacactctttgcaggagggaggagtctggcctcttcagtttctgtgtggtggcctggtgttcaggctgtgagatgggagcccactggcagaattccttcttgctttgctgagagtttctttttccttttttcctttttgcccaacaaattcctctctaagcacccttcagtatgtccgcgcgcctcattcttcctggttgtgtgacaagaacccggttttagttgaactaaggagcaaaattctgcaacacttccaccacaaattaaatagcatacatgggtgttttctaaaattttatacaaaaatatttcacttatgtattattattattattattattatttttgagacagaagtctcactcttgtcccccaggctggagtgcagtgacgtgatctcggctccctgcaacctccgcgatactcctgcctcagcctcccgagtagctgggattacaggcgcacaccaccaccccccgataatttttgtatttttagtagagagggggtttcaccatgttggccaggctgttctcaaactcctgacctcaggtgatccgccaccgtgcccggctatacaaaaatatttttaacagtaaaggaacagaaacaatgtgtagaggcctccctatgcttgaaattttggtcacatttggaattttaactcataatttcattcaaaatgttggattctactccataatataaatgtgtttgctttaatgtctattaaatgtctacatgtatagtctgttaactattttttcttcctagtcttctagtaaaattgatgctccaagaagatacacaacgttgaccatgtggattcagatatctcccgcttggatctcagcctggatcttgttgtttgagaagcatagattagctacaggttggtaaacttttttgtaagggccagatagtaaatatttaaacagtataatgagccacactgttcccggacagaacgaggtcctgctgtctgttctcgcggtccaataaggagatgcagacagactgggaaagaagggagtttatttctgcaactggttacagggagaaggttggagtaactcaccagaccaactaaaattagaggtttttctctagtgcttatgttgctggaaggaggtcccaatccagaccccaagagagggttcttggatttcatagaagaaagaatttgaggcgaatccatagggtaaagtgaaagtaagtttattaagaaagtaaaggaataaagaatggctactccataagtagaacagccccaagggtggcttgttgcccatttttatagttatttcttgatgacatgctaaacaagggatggattactcatgcctccccattttagaccatgtagggtaaagtcctgacattgccatgatgtttgtaaactgtcatgatgctggtgggagtgtagcagtgaggacgaccagaggtcactcacattgccatcttggttttggtgggtttgggccggcttctttactgcagactgttttatcggcagggtcttgatgacctatatcttctgcagacctcttatcttatcctgtgactaagaatgccttcacctcctggaaaagcagcacagtaggccttacacttactttatctagcccctattcaagatggagttgctctggcttaaatgcctctgatatgcctacatgtggggcctggggtctggaaaattacttcagaggcttgcaacaattacttaatctaaagtaggtcctggtacaaggtgtgcaagaacacctccattattttaattaaactctaaggtctgagaaagcccaagtgcggtcttaatggacttgttttcacattctaacctttgtactaaggcaccagtttctccagttctttaatgttttacttatatgttcatcagagtgacaataaggtattggtgaaggctaactgctctggtggctaatggagacctggcctgccacaacactgtttctgttacatgccctcaacccagccattatagcaaaaaacggccagagatagtatgtaaatgaattggcatgggtgtgttccagtaaaactttacttataaaaacaaacagatttggccaatggcctgcatttggcctgtaggctgtagtttaccaatccctggattagaaaatgccccaagagttcataaaagggaaatttttggccgagtgtggtggctcacccctgtaatcccagcactttgggaggctgaggcgggcagatcctgaggtcagcagttcgataccatcctggccaacatggtgaaaccctgtctctactaaaaatacaaaaattagctgggtgtggtggcgcacgccagtaatctcaactactcgggaggctgaggcaggagaatggcttgaacacgggaggtggagattgcagtgacccgagatcgtgccactgcactccagcctggcgacagagtgagactccatctaaaaataataataattaaaaaaaggcaagctttttcagctggaaaaaataaggacgaagagtggaagtggtaattctattggttattgaaggctgcacagtatttcaaacagcagagaggaaatgtcagcattattggtagagaaccaatataagcaaaggcaaatgtcttggggcttatatgtagatggcagtgggggacagggaggacagtaattagatcagtttgactgaaggaagaaactcgtgtcaaagagaaacattctaaatcatcagggctggaagagactttgctgatcatttgcttttcattgtacagatggggaaattaatgtgggcgatttcagatctggaaagaataaagagtggcatgcctcgaatactgtcttagttcgttttgtgctgctattacagcatgcccaagatgggtatttataatgaacagaaatgtattggctctttcctggaggtcaggaagtcccagattgaggggtgacatctgtcaagggcctttttgctgcatcatcccaaggtgcaagggcaaagagagggagggagagagagaaaaggggaccaaacttacccttttatggcaaacccactcctgtgataatggcattaatctattcatgaaaggtggatcctcatggtccaatcacctctcattaggccctgcctccaaatactgttgcattggagattaagtttccaacaaataattttggagggcacatttagaccatggcattctgtacctgacccccaaaactcatgtccttttcacatgcaaactacattcatttcattccaatagccccaacatcttaactgtttcagcaccaatttaaaagttcgaagtttagagtctcatttaaattagatatgggtgagactcaaggcacaatttatcttgagttaaaagccctccagctgtcagcctgtgaaatcaaacagattatctacttccaaaatacattagttgaatgagcataagatagacatccccattccaaatggaagaaataggaaagaagcatggagaaacaagtcccaggcaagttcaaaacccaattaagatgaataatactgaatcctaaggcttaagaataatattttttcactcagtgtcctacctttttgtataatgggttgggggttggtcccctaatgccttggcaaccctgcccctatggggggttagggagagctaggcctgtgcagcagctctcaggggttgaaatctcatgcctgcagctcctccaggctgttatctcatggtggtgactctacagttctggggtcttgggggtggacttaccctcatggctccacaaggactagtagggactttctgcagtggctctgatcccagagttctgctgggcattgccctagtgggggctctctgcggtgactctgcccatgagaaaagttctgcctgggcctccaggctgtctgagacatcctttgaaatctaggtagaagaagcgatgttcccacagctcttgcattctgtgtacctgcacacttaacaccacacggatactgctaaaatttgccatttggggtgctgtgccaggattcagagagcagagacttgacctggcctggagccaaggccccgtggatgccctaggcctttcttttgatgtattttctttttccaggcgttgtcattctgagcctgcaataggaaggtctgcatcagtaatctctcatgtgcctttggggtcattctccagttgtactgatgaataacctccagctttattctatccatgctaatctccttatcaaatggtcctttgggcacatccttggtttcctaaaaattttttttctctcaaaaaaaatctttttttattctctactatatagccagtctgagagtcctccaaatctctatttctcttttaattttaaattctgtctttaaataatttctttttcttgcattttactctatgcagttaagagaagccatgctgctccttcagtattttgcttagatatttcttccaccagacaccctagttcattgctcttaaattctgccttctgtaaagctcttgagcacgcacacaattcagccaagttctttgccacttaacaaggatggccatgactccagttttcaataaggtattcttcatttccatctgaggcccaatcagtatggcctttactgctcatatttctatgaacattctgattatgatggcttaagtaaagtttcagacttcctctatagctctcctcttcttttgagcccttaccagcatcatcctcaaagtccatttatagtaattttggctttttctagcctgctcctccaaattctttcagcttcgtttaattacatagttgtgaagctgcttccacattttcaggtatttgttgtagtaacagctccacctcttagtgccaattttctttcttagtctgttttgttctgctgtaacagaataccacagactgggtaatttataataaacataaatctatcagctcatgcttctggaggctggaaagtccaagatcgaggggctgcatgtggtgagggtcttgctgcattttcctatggcaggagggcagagagcaagagagagaaagagagagaaaaggggaccaaaggtactcttttataaggaacccactcctgcaataaaggcattaattcattcacgagggtatagacttcatggcctactcacctctcattaagatccacctcctaacactgttgagttgggtattaaatttccaactcatgccttttgggggacacattcaaactatagcaaatactaagttaaggaagtttcagctctgtctggcagcctcataatatttcaatgcttcatcatttgaatgcttattaattaaccaacttcctgtatgccatgtgatcagatgtcacaagaggagttcctttgggatgaacttagttctttgtgcaccattgtgaagtaacactgtagtgatggtgacaagacacatctggagcagttacctagacaagcaccaagtattagaagccttagtgtttcaatttgccatcaacttgctctgcaagcccagaccaaaccctgagcttccctctggctttctctttggttaaacaagaagcctttatcttcatctctccatcagaaccagtggcctgctcctctctcccttctctgctttcattgtccaccaacactgaagtcataaatgactagagggagctggagtgtgagggtccagaaacttgtatgatccaggtattcgtttattgattttttttcaagtaattagtgagcatttaccatgtatgaagtgctgaggataaataatgagcaaggcaagcaggcttctgccctcacaaagctcatattctagtcctgcgtatgtgtgttggtgggggaaatgtaaacaatatacaagtaaacaaacaaatgaaagaatttcagatggagataagtgctatgaagtagaacaaggtattgtgatagtgactagagcagtgcctgtggctagtctagtgagggaagacctctttgaggagagacgtggatgttgagaagagccaaagaagaagcactccagccagagaaccctgagtatgctgtgttggggatacagagagaaggcctgttgactgtgggttagtagtcaaggggaaatgcatggcagacaaagagaaagaggtggacaacacaaagaaatcaatgagttttaatctggtcaattgagtgactggacaattgcttctatttttaaaagagcgttcaagctgttacctgtagaatggtttgaaagggataatagtagaaaaggtaagatgataggcaaggttgtcaggcacagtggcttgtgaatataatcccagctacttgggaggttgaggcaggaggatcacttgtatccaggagttcaagatgagcctgagcaacacggcaagactctgtctctttaaaaacacaaaaaattagccaaatgtggtggcatgtgccttgagtcccagctactcaggaagctgaggtgggaggatcacttgaacctaggagttcaaggcttcattgagctatgatcatgccactgcacccctgcctgggtgacagagtgagactatatatatatatatatatatatatggctatttcagtagtccaggtgggtgccaagatcaaacatcacagtggagactgagagaagtggctggatttaggatctgttctggaagcagaagaaacaggacctgttgagggattggatgtgatgtccttggtagtgatggtaaaaggaaagcagaaatcaaggatgactcattaagttggagcttgaacaactaggtcggtggcgtgccttttttttcttttgagtggaatgttgagagatgaacagtttgagtgggaggtgtggtagtccgtaggtctgttgtgggtgtgctaaattggagatgcctctgagactccaggtaaggatatgcagtcggcatgtggaagtacttttctttggtgtctccagtcttaaaggattagcattctctctaacactcatataataatcccagccttgatttgttcgaccatgtattttataatattccctcccccctggaatttctgggactccttagagatatattgattcaatgggatccatcctagtttctgcatttcacctctgccagccatcctgcccccacctctgttcaaccccttgccactacctggctccctctgcccacctacttggccccacatggtcatctttaagggactgatatatgctgtcaaattagtcttcccagagattaagccatttgcattcccattagcagggcaggatttgtccatttccccacattttcaccaatatcaggcactagccagttagatagatggtaacacatttcaatttgcattgcaaagatatgctcctgaacagcagagtattctatgtctgtaaatagaaacacagaatcaattcaagtgcccagaaaccacatgcaattattagggaatttcaggatgcagatgataacaacagttaacatttgttgagatctcgttatgtgccgggcactgtactaaagcactctgcaggtattattacaacgtcttgatagggtggatgttatgatcagccttcattttctagatgtggaaactgaggcaaagggaaattaagtcatttgttcaaggggcagagctggaattcagatcccaggtctgtcaaagcctaatcccagccagccttccttctgttgctccaacggggagtcctactcaaaactgttcctggtcctgtatgacagcattgataagactcctggaaatttttgttacttcctagcctccactttctaccttcccattttctcctaattttctcaatctttgttggggttttctccttcttgacacctggccaatataatcctgcaggatcctcactcaacaaaacatcccagtcatgagtggggcaggtaaggaaagcctcccgcaggtttacagggttgggaggggactccctggcaggtagaccgccatctcctccacctcgctttcctactcacaggagtgaggtaaactttgttctttcctgataataataatgagataaagtatattgagggcctactgtttgtgcatgcactgttttaagtactacaactacccaatggggtactcaccatgatagaaattttatgtgcatattgtaaaaaatgtgaataatagagtatctaaagactgccactgctaagatattggtgtattcccttccagtatttttgcctaacataagtatttttaatatttttctagaatgccatgtcatacatccaataaaattcaactctgcaagcatgagagagaagaggaaggaaaagagagaatctgaagtgtgagtgattctgtttaccattccacagagtaagtggctgcctgggagtgtgtgtgagatgggagtgggagagaatcttctgttcttcccttggacctcagttccacggagcttttcagcgtgtaaaacatcttaccatggacattctgggtttcggtttaaaaagatgtatttttggtttgacacagtctctcactgaaaccagctgcttcagctgacagtcaaactaagagtcaaggattaactgtacagttagggacacagcagccatggcaaaacttactgagaaatggccatctcccatgtagcattctgctaagggatttcaagggcattttgacttttgacttttttacctggcacgctgacttggcgagctaacccctgtgcaagatgccactcaagaagccactccgttgtttataattaagacagcaggtgaggtggccctgtactttgagatttaaacaatagtgacttaagctctttctcctgttttctgtaggaagtccagcatgcttactgagactccctccatccctggggctgacagtcccgtgggtttgttctggctctaggtgtccacccccgaggagctctgaattcacagtgtcgcatgaagggacagcaccctgctctccctgtgcaaggcactgagcttcatgtcaaacttggcctctgtgttttgttcccaccaggcccttctcccaagaaatgtacacgtagcaaactttactcaaagtgtgaggactcaggagggattttaaaaaatcataaaaatgccgagtttaaaattagatcgtattagtgttgttttccttagaaggaagaaaaaaagtttaaaaattaaaaaaagagataaaattagatcttatatatctctctcctggaaagttccttaacagccttgctgtaggggaaatgtctttctcaccgaacacttttcttggaagattccggccttccaccttgttgtttgccttctctgtctgtaaaacattcaaattctctcatttatcctagaaggcagtttagctctacagcccctacacagtcctagacctcctttctgtatctactattaagtaccattcacaccaagggtcacctactctgagtttcaatcattattaataaagaagggaaagtggaggctttgaaattcccatattttcttcatgtctctccaccagtctttgtaagtgaaatagaggctgatagagatttactttctcattgatattaactatgcttctcctcttagaagacagaggcatctgtagtcagtgtcaaatatttcccaccctaccatatatatatatgaaatacatggattatgttctatggacaattgggtatcttgtttgttttagttactattgctgtataacaaatcattccaaacttacaggttaatcaacaacaatttattatgcccacagattctgcagatcagggatttgagaggatcatggtggaatcacttgtttctgttccatgatgtctggggcctcaaatggggagatacagaggttggggatggcttcgtgggtgagggctagaattattaagagggttatcacttacatgcctggcagttgatgtaagtcatcagctgagatgtcagctggggacatccactgaaatacctactcatggcctgtccatgtggtgccttaggcctcgtcacagcatggtggctgggtcccaagagtgagcatctcaagagagcaaggtgaaagtgcatgacattttaatgagtcagccttgaaagtcacataatgttagttctgcactattcttggtcaaggcagacactgagatctgcccagcttcaaggggacgtggcaaagaccccatcatttgataggaggatcgtcgaggtcacattgtagtgaaagcctgtgagacgagtggtgatgtttctgccatgttggaaaatgcaatctgctacactgctcttttcatttaacatatcataccattaaaataatccatcaactctgtgaatacatccatagaacttattcatttactagttccttagtataggacttttctcatcacttccccataagagagaagaaggaggtatggttattttccttccctaaaaccaagagagagaggcccaaagagaattatttgacaagtgggattcctattcctgcagtgtcgactccattaatttggggtctgttatctttcctttgatggtttttgagtcttggaccagcaggagcacctgaggctgcttaggacatggatataggggtctgtggcttctcaggtgtgtcaaggacacatacatttctcctgggtcgagggaacaccttaggaagtgggacttgagctgttctgccattattccccaagtgggtttcccactggatgagatacccctggtagaaggaaagtgtggggaagactgtggttggggaggaaaaggaaaggaagcagctggagccctagccaggccacccatgtaggtgaatatgcaggggatggccctacgacattctccaaagaacccaatggatgagccccatgaaggagccacacagcaggagtcaaagctcagtctgcattatccaggaaccagtgaccactgaaataaaaaggatcagctcctcatcataagcagctaaatgaggaaacatctctgtccttccctctttccatcctgccccaacagcagagggcatgcgcataggagatggcgtggtgagaagagaccatcctctttcccctacaacctttaagcagcttagaaactcaagtctaggtttgtgtatgtgtttgggcgtggtgaggaaaagagagtcattacaagaaaacaagtttcaagttttgaaatgcatgggactgagtcctacagaaacaaaaatgtcactgaataacccttaataactggaaataaatggaattgcactaagatgatgtcaagcaccattaaagaggatttgagaacacacagttggtggcaattctgtgtttgaaacagtggtaagctgagactccttgataaactaggtacaattgtagttattgggtatcagccttttttaaagacttaattcttagccaaaatgcccttccaggaaggctgtacttttcccagctccttgaagatgcccacttcacgggatgacatttattcaggcctggagaggtgcaatctcattatgtgggtcattagagcaacacattaaaggcgacaaagggagtgtcgccaaaagactttgtagcaagttatgtggaagtgagcaagagaacacgactgcctcacctcttgggggtggcgaagggttatgtttagatggggtgtatatgagtgtctggggttttttactcatattgatggccaaattattttccccttctgattccctttgagaatccacttcactacctgcttcttgctgcaaactgggagttgtaaaatcagagagtctagggtgtcacccgaattgccctcatgtatggcatagctgtgtgtgtagagcagaacgaggtagggaggaaaagtcatgctgagctcaggctgagaaagaagagggaatcagaaagatgggccatttgaaagcaaaactgccttgaaatctctaataggctctgtcttgcaaacaagaaggggaagatagggtgagaggggatgttagtttttagcaactgttttaaaactgacaacagaggaagagagaccagaccacaaagttaacatttgcaacttaggcatcatttgattgtttaaaaaagtccccagtcttaggaggggctgtccttgggtgaagggttctgttttgaactggagggagatctgggtgaagcatggatgaagtatatactcccttcctcaaatcactctccatctgcatcacctgatgctggaaatccccaggattagcttttataaagttttggctacattatgaagttcatttaatgccttccacaatggcgtctcaatttacaggtgagctaactgaggcttggagcagttaaggcaatgagtgtaagtctgcgcagctggtgaagcacacagcccaggatttggacctagatctgtccgattctaaattctttcgatcacaccagtggccccagcagatgctcactcctttagattaagtaccctctccgtcaactgcattacacagtttcttaagcaaatagcatggaggctcagactatgagctttggagtcagtagggcttgaatttaaattttgactccagccttgatcatttatgtgactttgggcacacaacgcaaagtctactcaaaaaaagctgtgaggaggatgtgcagcacagctgtggtaaacactctactagattattattattgttattattattattttgagacggagactctctctctgtcgcccaggctggagtgcagtgacacggccttggctcactgcagcctcaacctcctgggctcgagccattatcctacctcagcctcccaagtagctgggacaacaggtgcatgccaccacgcctggctaatttttgttttttaattgagatagagtttcactatgttgcccaggcttgtctcaaattcctgggctcaagaagtgatcctcccacctcagcctcctaaagtcctgggattacaagtgtaagccaccacgcctggcctattgttaatttttaaaaagctgttgtctctctttgatccataagtgtgtgataatagaacaggagggggacagttaacaatgatcagaacactagctaacacttcttgagcacttaggatgcatcagacactgtgcgaattgctttccatggtactatcttaatcttcctaacaattcaacgatatgtaccattagtcaacctcaacgtataaatagaaagcacatccagctacaggtagaggagccaggatctgaacctaggtgggtgaactctggagcctgtgcttacaccaggaggtaagcttgcaggggccctgcgggactttgggagtagatggggatgcttaaggagggttgagtaggaggctgtggtcctggggtagtgtgtgggctttgggcattggagggtggggaagaaggtgacaagaacggggtgagataaggtaaccatggagtggggatttggacatttgaaacagttgtcacctgtaggatgatgtcttagttcattcttgcactgctataaaagcacacctgagactaggttatttataaagaaaagaggtttgattggctcacagttctgcaggctgtacaggaagcaaagcagcttctgcttctggggaggcctttggaagcttccaatcatggcagagggcaaagggggagtgaggtatttcatggggcaggagcaggagcaaaagagagtgagaggaggaggtgctgcacacttttaaacaaccagatctcgtgagatctcactcactgtcatgagaacagcaccaaggagatggtgctaaaccattcatgagaaactgctcccatgatccagtcacctcccatggggccccaccttcaacactggagataataattcagcctgagatttggtggggacacagatccaaaccatatcggatggtttccagggaaaggcatttgcatctgaatcccaaaggcgaatcacagactgtcagggctgggagttccttagacatggtctagtctgatggtcttttaaactgtacatatggaagcttagagtccgtcaagggtatgaatcgatagaggcagtgggatggaggctgagcaaaggggtcttcaagaccttctggtttgcatcaaccaaagtcgttccatttctctttttaccctttttgttgttgttgaggtacagcttatatataataaagcacacgaatttcaattcatgtgatgaggctgggcatggtgatgcatgcctggaatcccagcattctgggaagctgaggtgggtggatatcttgagctcaggagttcaagaccagtttgggcaacatggcaaaaccccaactctacaagaaatacaaaaattagctgggcatggtggctcatggctgtagtctcagctacttaggaggctgaggtgggtggatcacttgagcccgtgaggttgaggctgcagtgagctttgattgtgtcactgcactccagcctgggtgacagagtgaggccctgtctcaaaagatacatgaaataaaataaagcctgatgagtttgtataaacttatgcacccatgtaaccacagatcaagataaagaatctttccaaagtcccagtaagctctctctggttctttcccatcagtgctgtcaccaaagagaaccaccattttcatattatctgttttcgaactcatataaatggaatcgtagagcatgcgttcattttgtctaacttcttttgttcaaaattatgtctgggagattcatccatgttctagcatgtaggagccgcccaccctttttcattgctgtgtagtattctgttgtgtgactataccagaatttatttagcttttctgcttttgatggacatttgggttgtttccatattttgatgttatgaacatagctgctatgaacactcttgcacagcctttttggggaaaaacgaacacatttctgtcgggtatatacccagagtggtattgcagggttactgggtggctgcatgtttagctttggtgggtagggcagctctatttttgaacagatgtttcatagagtaggaatcctcatgtaagattttgcctggagaaagggtgtgattgcttacatttttctttacatggaaaaagtttcaattcctgtagtgcaatcttctgcatttacagatggtgaaactgacactcagaaagtgatttgctcagactcaaactgcggtaaagccacagccagatcactagactgaacattttgtattgactttcaaactctgtgaaacagatcctaaatatcactcaaactggttgctggtcagatgtggacaggaacccataattagagtcagaagccttgggttcagtctcaaaactctcactaacaaatgtgtgagtcagggtgaggcactgctgtggacctccatctccctaacagggaaatggatgtatttgcttcacagcgttgctggatggaaggaggtaatgatggggagacattttatagctgggaagctcttagcaaattgttattatcattatcaaaatgtattctaaggggatgcttgggcaagcatgctgttttcttgtggtatgaatgtttattcactattttctgttttatattttagcctgagttaatagtttttaatgaacatttcttccccctcattaaagagctagtatggcagttagtattttccggagatagccacaccaagtatagcccatcctccatgctgctcttacactggggacatttttataatgagacacacctgcattgaagcgggggtctgtgtttcctccccttgaacctgggcaggcttttgtaactgccttgactcactgaaagtgcagaaatggcagtgcgcaaggaggaatgcagagttagaaaggaaaagtctagatttcggggtgtttcctgcagagaacagaaaccctccctgggaggagacactgctgtggcttttacttttctggttttacactgtggtcctattcacttttcagatttcttcattaaaaccttcccccaaagaggaaagcctatgtctaggaaccaccctgacaagttaaagctgaggtgagaactgagtgctccatagcttccaattcaggcagagttttagtcattttgggggagcctgttgactctgggagaaaggcctagagctcagattatcctggggttgtgggggctgggaacaggagctttgagtgacagtatacaggggaatagtgacagctcccctttgcctgaggggcagatggactcctagcacccagaaccctagacgcagaatggcgcccatgggggtgagtggtcgagaggcacacagagagagctggatttctgccccttgactttcccctccctgagagctccaggtttccaagaaaaaaggtcctcaccacagttctaaaaataataactatcttggctgggcacagcggttcacacctgtaatgccagcactttgggaggctgaggtgggaggtttgcttgagcccaggagttggagaccagcctgggaaacatagtgagatcctgtctctacaaaaaatacagaaaacttagccaagcgtggtggctcctacctgtagtcccagctactcagaaggctgaggcaggatgattgcttgagcccaggagttgaaggttacagtgagctatgaccacacaactgcacttcagcctgggcaacagagagagaccatgtctcaaacacatacattcaacacatacatacatgccttatatgtgcaaatcactttacatactgggaggcagtttcatacatgtgacttttttttatttttccaatgaccctgtaaataaaccagagaattgtatcatcgtcatcatcatcttaatgttatgtttaaataaactgagagggtgaataaaggcttcacccaaggtcacacagtagcaggtggaaatgccagtgggaaaaccaggtattctggcttcgtgagttttctttcattgcattgcatacttgatccgtggaggggtgggagtttggggcacacagcagatcaatggcagagctaacttgggggagaggcacctttcacccctcagattgcccccagaaggtagctgtctctttggctggcagcatggtgttgattctatgtgagaataaaatgtcctgggctggccacctctgccccacctttgtccccctacctccaccaccccatgactccccagcccctatcagaaaagaaccattctcagtcatttacaccctcattaccatttaagggcttatgctttctcttttagcaatatttgcttttaaatcttatcgcttattatgatttttgtctcctggaaaacatggtttctggcatcagtaagctgatagaaaagcattatctcaggggcagggtgggagtgagtgagagagattttatagacaccctcctcgtgtgtcagcagatcctagctacttgaatcacagcaagtcacttatcaaatatctgagtgctggatgcccgggacagagtgatgaatagaaagtggtccatgcaggtgctgggatacagcatgaagagagtgcagttcatggcaggggccacagactggtgggcgagacaggcaaggaagcaagtaattatgatctgctaagtgctactatagctgtaagtgttcagggtgcctgggagcatgaagtaactggggtcggagtggggtggaggtgatgttgtttggcggaatctggaaaggtaatagaacttccctttattgaatatcttagtccagatactctagacaagcaaatctgagggatcgtgtgctcaaaccagggcaggagtgtgaccttagggaagaaggcatgagggaaagggcgtgcggtggtgaaggaggagagtaacgtgaaggaatgtgttacggttgtgaccaccgttctgcagcagccctgtaggctactccatcttgctggacagtcccaagaggtcttacggacctctgccgcctgagcagggctctacaggagggcaaacacctcttctgcttttttcccattttgagtcccccagtagctaagcttgctccatggggagtcaccttttgtgcatttctagtttgagtcacatgccctgcagctggcaagtctgggggtgatgggaactgccagagatggctggtgtcagccataagggcaagcagagatctagcagccaagatgccagcagagactataaaaggagtctctttgagatgtcggagcatttgcacacagtggattgtcaaatcctcacaatggccctgtgttgttcattgaattgtgtaccccaaaaagataggttgaagtcctaacccctggtacctgtgaatgtgaccccatttagaaatagggtctttgcagatgtaatcaagatgtgtttaagatgaggtcatgctggagtagggcaggcccttaatctgatatgaatgttatcctttaggaagagaagagatacagaggcaggtgcacatagagaggagaatgccacatgaggacacagatgcacgggtgaatgctctgtgatgatggagacagagactgcaggggcacatctacaagccaaggaataccaaggacttctggcaacaccagaagctaagagaacggtgtgaaatgggttctctctgcgagcctctagagagagcatggccctgccaacaccttgattttggactttggttttagaagtgtcagagaatacatttctgttattttaagcacccccgccctttatggtactttgtaacggcagccccaggaaatcaaatgaaacaaggatcttgcattttcacagctaataattagaggagctggggtctgaagccaggtttgcctgttgcttagatttgatttgaaaaatggtgaaggctttgcaggggtgggatgggggagaccaaaacatgttcatgtctgtgggtaaattgtaggtgtatatatttttgaggtacatgagatattttgatacaggcgtgcaatgcataacaatcacaccagggtaaatggggtatccatcacctcaaacatttatcctttgtgttgcaagtaatccaattctattcttttagttatttaaaaatgaacaattattattattattttactatagtcgctgttgtgctagcaaacactagggcttatttattctttctatttttttgtacccattaactatccccactgactacccttcccagcctctggtaaccatccttctacctctatctccatgagttcaattgttttcattcttagctcccacagataagtgagaacatgtgatgtttgtctttctgtatctggcttgtttcacttaacataatgacctctggttccgtccatgttgttggaaatgacaggatctcattctcttttatggctgaatagctctctattgtgtgtatgtaccacattttctttatccatttgtctgttaatggacacttagtttgcttctaagtcttggctattatgcatagtgctgcaataagcatagaagtgaagataactcttcaatatactgattaaaataaaaaattaaaaaacaaggtggtgctccctcacacacacaagagagcagctctgtccaatacagaggccttgtggctactgagtgcctgaactgtggccagtctacactgaaaggggctgtgtgtgaaaaatacgtactgggtttagaagacctagcacagaaaagaatgtaaagtatccaattactaatttttaatattgatgacatatcagaatgattatattttggatatagtgggctaaataaaatatatcattaagcttccttgcacctgttaaaaaaagcaaccacaagaaaattatagtcacatatgtgcttgtgggatttctgttgaacagcactgctctggaatgtgagttctttgaaggcagagaccatctctgtactgctgactgtggtccaagagccagagcagggcctgacatacaagagtttctcaacacataattgtggataattaaatgaatgaataaacgaatgaccaaatccaatccaactctgaatctgctcgtctggtccctgtgaacataggattggatgtaattttcaccttgccttgtctctctgggcagttcttcaatggctgaggcttacagagagaatgcatgccgcacagtgctagctaatggagaggctggatgtgtggtggaatttggagaataaaaatggccagagtatttccaaccacaatggcagtgaccacttactggatacaaattctgtgcctggcatcattctaggcacattatatggagtgactcattttaattctaacaacctatgacatcagtcccaccatcaactctatttgacagacagaggaaattaaagctcagacagataaaattatgcccccagggttacagagctgttttttttccgagttctgtctgacatgacacttgcactcttcaccaccatcacagaacacagagaagaggggactgggggtcctgccaacacagggtgacactgaaccaggtctgttcaattctgaggccccagctcctgaaagcaggtggccccagccctccaggatttggaagactcattgtctgtgtctggtaccgtggagcatttggccacatatcgtctgtgcatctagacaagtcctggcatgcatccagccatatcttgcccatgcatcttcttcaccagatggcgggaccaccctctgtacctatgatgtggcaatgactgcacaggtgagtgagcattccctgtgttggaggaggggccctgtgggcggtggttgaatcatgggggtgttccttcatgaatggtttagcaccatctcccttggtactgtcatcgcgatagtgagtgagttcttgtgagatctggttgttcgaaagtgtgtagcacctcctccttctctcttgctcccactcccaccatgtgagatgtctcactccccctttgccttccaccatgattagaagcttcctgagacctccccagaaggagaaggaactatgcttcctgtacagcctgcagaaccatgagccaattaaatctcttttctttataaattacccagtcttaggtatttctttacagcctcgggagaatggactaatacaatgggcaatccagactgagcaaaccaaaggggaaaaagcacaaagatataaacctatggtttacatttggggaagtaagtagtccagagtggcagtggtatgtgtgtttgaggtgggtggacagagggaacatcttatggagagaaagcatcagggaagggggctggaggcagattgtatgaaaatctgaaggccaggtaaggggcttggactctctctggggtccctgaggagcagggataggatgggcattgctgaatgctgccaagtctgttttggctgtttagtggagaaccgattagaggcaggaggccagatgctgtttgaagccagttcattctgtgtgctcatggtaagtgggcattaagagtagatggcacaggaactgtgtccatctgcatgtcttcccttacagctctatggaaagacttgtcccatgtaggtcccagcagcctcattttcaggagttagtttgctaacaggtgcaaagctttctgggaatcaagcaaaattacaatgagtcttcatataatggagcacgtaatggaattatcttccacctgatcttgggacttcctttccacccaagctctttgtacagcaggtcatctgtgggccctaggaagcaggcagaaataacagcaagcaggcacctgctaagtgtcagccactgttcaaggctcttgacatgtgttaacaactttagttcccacaatgtatcatggagacaggagcaattgttatccccattttacagattagacaatcagataggtcaagtgactcgttgaaggtcacacagccagtgagtggaagagctggattcaaactccagagaccacagtcttaactgctatcttatattgcctctccctttttagatacgatacttattatttctacaatgatcacagctccttatgaaatcggtaataccattacttttcagtttatagatgaacaaaccaaggttcaaagaggattcatagttgtcacaggtcacacagccagaaagtggctgagctagaacttgaacccaggtctgtctgactttgtagcctcatccctgttttccaggaaggggtgaggaaagaggagagaaggtgaatgcaggggcctgccttgtgattcctcaccagagggcaggcatcctccagcctatgatgtttgggtctcatgtctccataagaatgagattttttgttttcataatttgaaaagtccacagtagggcacaaacatcgtgactctacccttggccacatccacctcttctcttggccaggcctttggctctttcaagttgtgacagcaaagccctgtctcagagctggagcttgtaaatttcagggctcccatctgggtctggaggatagtggtttcagggagtggtttctttatgtgcaaagaaaactgctattcaaatcccatctcacttcacatttcaaaactctgctcataggccagtgtgtgtgcacatccgtgattgtcaacaggcatccagggatggggcgggaagtgatgctccatggccaccataggtcagataggaactgggaggctgacatataatgaattaggcgttgcttcattttctgatcagcatcaccttcagctgatgctcatctagcaaggctgcctttgaggaaatctgagcagtgtgtagtaataacatatttgagcactcattacaagccaggaactacattaagcatgatatacacaccacctcacttagtgctcaaacaatgctatcacagatttcattacccctggttgagagatggggaaaccaagtggcaaagtgggttgccccatggctgaggcaagattcggacccaggtcagactctttaagtgtacaaattgaacacctgtatctctgactactgtgtgaaaaatagaatgtaggagagcaaagacggatgcagagagaccagttaggaggcaactgaagtagtccaggtaagacaaaacagttgcttggactaagatggtactatggaagtagtaagaagtgggtgaattcagaatatagttgaaagaaaggcaaaacaacagggcttgtcaatggagtggaggtgagccatatgggaaagagatgaatcaaggataagacctagacttttggcctcagcaacaaagtacaaggaggtgccgtttagtgagatggagttgttaagggcaggagagagtttggcggtgggtgtccagagttaacttggtgggtcaattagacaaccatgtggagacatgaccaggggagaggtgggggaaggaggtgtggatttgtcaccagtttatggatccaatttaaagtcttggggtgggtggatgagatcatcaaatggaggattataaatagaaaaatagccaagggcagaactttgtagagcctaacaattaaaggtcaagttgaggaggggtagtgggcagaggagactgagaaggaatagcagcaggtaggaggacaaccaggtactgatcaaagaggaaccatgttttaagaaggaggggtgatcatctgctcactggcacagaaggtcaagtaagacaaggagacagttggccagtggctttggcaaagtatagcccattgttgactttgacatttcaggaggaatgaatggtttagacctgtcatgttggctgtccttgaatttctgggcaagaattcccaagattatggcgcctagagatggcagagctgacattcagacagtcccaggtttgaacctcagatctgccagtagctgtgtgaccttgggcagttactatcccttcttgaacttcattttcctcatctatgcaatgggagtgataatgcttacaacttgaggcaaggattgaatgaaataataagtaaaaacataaagcagcaaatacttaggaggtattagatatttttattctttttattttaaaaataaagacaggatctcactctatcacccaggccggagtgcagtgatatgatcatagttcactgcagcctcgacctcctgggctcaagtgatcctcctgcctcagccacctgagtagctggaactacaggcatgcaccaccatgcctggagaattttttatttttagtagagatgggggtctcactatgttgcccaggctggtcttgatctcctgacctcaagtgatcctcccgccttggcctaccaaagtgctgagattacaggcatgagttactgtgcctggcttattattttaatttttatatatttttaaaaccattgttagcacaagagtgatacctatatttctgagaaaaaccaatgacctaattttgagcagagctttattaatgccagggaatctgacggaaaattctttgagggttgagacattcttttccctgtgccaccccaaatgtccagcacctaagtagatttaatccaatcaggtcaatccctattctgagcagttttatattgctccctaggaagagacctagatccctacctgggctcacaagactgggtagtctggttccacctacctgtgctgcctggtcacacaccatactcccccggcgactctcagttccccaacgacggcactgtgcttggtccatgcgctatggggcgctgcacattctgttgcctcccctacacacttccttccctgtcctcttccctgtgttcatttcttcttgtctcctggggcagtggttacttccccaggaagcccttcctgaacttctggaccaggtcgattcctttcttagaggctaccagagcccctgttcctctccttcctggcacttaacatatttctggtcatacattcttggtgcacatcttagtttaacacctgactttatcactagactctaagcacatgggggcaggagcagacctgttttgctcaccagtgtgtgccttgtattgagcccagggcctggtacacagtaggagggcaacacataattgtggactgagtgagtgagtgggtatttaatgcaatgaatacatgagcagatggctttccctttgtagagcaaagcaggtgtctccaaaaggttgttggaaaggcaaatataataccaaatcctatttcatttactttaattacaatactaaggagtggaataaatcttgcccttgaaatgtaataaaagcatactttaaaatcccagctgtctttttcactggcttatttttaaaaatgataatttcctgataagccacaagtaagaccacttaaaatagattcctgacttggctcggccactaactagctgctgatcatagacaagtcacttacactctgcatgtcagcatttgcagtgtatggttcttgtgaggctctgggtcgatggcgtgagagccctttgatagcaagctcttatttattatccattattctcagtcttattaataataagaaggaacaggctgcgtgccagagatagttgagtagatttgcagggctggaggattgaggccacagagaaaaatgaaaagaaataagattggttgagaaatatttaagggggggggggttgggaaatgaagggtggaggggaccagagacaataatggctgggggtttatgtctatcaggctgagtaaaaggtggggctgttggtgacctgaataaaatccctctcatggccaaattcttagaaactgcacagggaaggagagaaaggaatcaactccttggctcaccatgtggtggcataagagagatgccgagtgactcccaggtgaccttggctgatcagagctgtggctctgaggtcggggaggctggcagctactggtgaggagggtgaagctggtggtgcttggtccaccaggcaaattatgctgcccagcgcaacctgagctccaccactaggaggggacacagaagcccccaggcctgggagaaggagcaaagccagcaggacagggaggggaggggtgtggaatccaggccttcagggctgggcagaaaatggaaaaaattgggcagcccagaggcgatggggtctcgaagagcccagcccagttaaagggcagcagcacgtcagcaacaagcagcttgcgctgtgtgaggatgcggcacccaccgtctctatctagcttttccagagaggttgcgcgtccttagttttaaatgtggaatcatgccatttgcagaaaaacaaaaagcaaccaagcaaacaacaacaacaacacctctgcaggccaaacaggacaggtctgatgactgtgcctgggctgctcttttgtgatctcatttgatgccccacttcggggctccagacaggtccctgccctccccgttccggggtggggatggagaagaccatttgactctgtgggaaagggtcctgtaagctcacctaacccatcttccatctttaagaaaaccactagaagtgaacaaacatagagtaaaatgtcagctcgccgtaggtgctatgaataaagataatgcagggtcaaggggagagagagtgatggaagcattgattttcggttggacgaccaggagaggtctctgtatccttcctcctcctgcgctctcagcggcttaacaagatttcaccaggtttcccgggcttcattcataggtgctaatgagcagctgggggttgactgagtagctacagtaatccaaaagggcttcccttccaccctctacatccctggccttagaattagcctcagccccagcaaaggtagcaggtgcaaagccaaaatcctgattacgagtaagtatttttgcctctacagctggaagcagctggccgctgagtctgggatgggaggaggctgcatgctgcaggacagcagctgggggaggggaggaagcaggagccaccagcttctggccatggttgttcatctcccgctcagccttactcagagggcacttgacagacataagggatgtggtcagtcagggccggtcccgctgcctcacatatgtcttctctcacccaggtctccctgcctgaaatcttatcatcagacagtaactttcctgaaagctgcagtggcatctctaaatctcttcttttccaagacagaaaactgtgggagttgtaatgcttcccatctcaaagagaaaaagagttctcactgtgagctgtaaggccatctgtgatatgcagccccaactcactgggatggctacataattttgggggcccagtgcaaaatgacaaattggcctgcagcattattgccatctccctgagcacagagatttctgtctttttgttttggcttgatgatggctctatcttcagtgcctggcacctgatagaggcttactattttgttgttagtgttgaataaaagcatagtgtttgagtcatgatgtggatgtattggtaggacttctttcaacatttattaagtttttttggcattgggctaaggaagtggggtttcagccctggcttcacaggggaattgctccagcaattcttaaaaatcccaatgccaggctttactttggactagttatgtcagaatctagtgggggtgtgtgaggggccgtcagcattttcaagctccccagctgatttcaatgtgcagccaagtttgaggaccggtgcgctggctcaaccgcacttgctctcagtggctgttgtgtattgttaggcagcttgttaactgctcagaaggtccagggccattttcagattttccagattgttaaatttgagaaggagggtctgtcctgttaataagcttgccagggaattttgcttataccaaagtttgcaaacctaaactgttctcaatcctattcattttacagacaggaaaaaagagacagagagaggttaagtagtttgcccacggtaacaaagtaggtaactggcagaaccaggatttgaacctaaggcttctgagcttacctagtagcttctctgctttttctttttgtttttgtttttttaagatggagcctcgctctgtcacccaggctggagtgccgtggtgcgatctcagctcactgcaacctctgcctcccgggttcaagcgattctcctacctcagcctcctgagtagctgggattacaggtgcgcgccaccacacccggctaatttttgtatttttagtagcaatggtgtttcaccatgttgatcaggctggtctccaactcctgacctcatgatgtgcctgcctcggcctcctaaagtgctgggattacaggcgtgagccactgtgcctggcgcttctctgctttttctttgtgataaaaatctaagtgtgctccaggagttggttgtgaaaataaaataaagataaggttaggtgcagtggttcatgcctgtaatcccagcactttgggagaccaaggtgggaggatcacttgagctcaggagtttgagaccagcccaggcaacataacctagtaagaccccacccccatctctacaaataataaaaaagataagattaagaggatatgcatgttatattgtatattttgaagatggagaagttggtatttctactccatggtgaggaaacaggtccagcctgggggactaactcccactcccagggtctttggggctttaagaggcagagctgggattgcagatgtgggccattttctccagactcttaggttttgcaggtgaatcattcaacacctagggcatcccagaatccatgttgattggtgcctaataggcctgtaaccaatgatgagaaagtgagtggcgggaaggctggctaggtgagtgagtgaaccagtgagtgtgaaggagtcatttgtctatttcatggattctttctatttttcaagtagagttggatcactagagggcaatatcggccaagagaaagaagaattcttcaccaccgtttctaggactggtgaaggtaagacatctgtgtctgtggatttaaaccaaaaagggagactctaatttacagagcagttaaagtgagctttgctttcccctgggctttcaggctgatgagaacctttctcaagccccattaacacgtacagccactccagacctttctagacttaaaaccaacagggcaaacgggagaggagggaaatcttggttggcctgaaaagtggatgtttatagataataggaggttttagaaaaagacattttgtagcttctcagacttttacaacattgatgggagttaatgtttcgagaaatggtattatgatgaagttgtatgctgaattaattttccataaataagaccatacatttccacagattgctttgcctgctgtataatgagagtgtgtgctcttgctggatgagcattctctccccttcctccacctaccgcctcttctctccatgagccctagagtaaaagtgatctgggtatgtctccactggttgtaaggccttgagtaagtcacttaattcttctgaatctcagggtcatcaatggtgacattgcaagtttgtcctgaggtttaaacacagaacatgtgggtctccttggaactcctttcaagcttctgtttctttgtcttctcttctctgctgttccattaagcaccaaaagttctgatgtcaaaagagcagctaagtctttactgagaattcaccagttgcccctccctggggccatcactaaccccaagatgtgcattttggaagctatctgaattggagggggcccctaaggaatgaatttcaagtgaaagcctttcagactcagcacctactcagtgctaataatcattactcctattaaggacatacgatgtgctaagcattgtgctgaaggttttgtaggcattacctcccttaatccttgccacaaaccttatgaggtaggtgttttgttacatcttttttacagatggggaaactgaggatcagagaacttaagtaacctagccaaggtcacacagctattaagtggcaaagctggagtcaatcccaggtctgattccaacccttatggtcaagaagggggctaggaataacatatgtgtatcattcaccccatgccagggtgacttccatagaaaggttgtatgtccaggataccagaaggaagaggaggccacacacgatagaaacacctggagacacttcccagaagtggggtcatttgagcagggccctgaggattagtctgggttctggcagacagagatgaggagggaagagagtattagaggaaagaccaaatgcaaagacaaggagactggagagcatggcatttgttttggggatgtggatgtatccagtaatgtgccaccatatgagcgggtgctacctatcattatttgcattttacacattaggaaaatgaggcacagagagggtaactgatttggccaaggtcacacagctaagtggcagggctggaatttaaactgccatctctctgactccacttccacagggtagagagcacatatggatctcaattcagtcacaactaagagaaaggctttagtacctgcggcttctcggaggatcccagggccagcagcccagccatgccagaggtttgcacatcaatatgcccctgacctggaaatgtagcggggagaatagtggggacaggacaatgttcaagttctaagacaccaacagtaagaatctacctttgcgccacacccagctttcttctcactcccgccttgggatcagattactctcttgcattcttttacatttcataaaaactgttcattaaccatgtgccagacccttaaacaatactgaggcagaaggttggtttagaaacctgtgggaggtcatgtagtgagcaagtggtagatggaggattcattcccagcctgggctgctcactgctgtgctattcccctctcttggggaaaagagcaggggacagatgaagagatgggctcttgtgaagcccatcctgtttctcctaatggccccacaaggcagctggttataggtgaggctcaggagctctgaatggtttaccagggctggtggaatcaacacaggagtccagatcctgacccttcatgctgcgccacgtccacctgccctcagagtctccaggccaccacctctcctccagtctgtccccaggcagcagttgctggtggaccctgggtgtctccaacaccaccacagccaaggtcctggcctcaggctcttgttaacctgagaacttctgcctgcagggggcagggaccccaggcccctggtagttctgtttatgtgggttttggaatcaatggagtcatggctggtttcattctatggccagaaactgccttggtcctagagggacatttatagggccccaggcaatatccacagatggaccagatgctgatgttggcatacacacagaaatcctgtttggagaaaagtaaggtataaagggcaccagaggggatcccctgccatggaattaaggggaatcaccaaggtagtgatgagagtggagactcatctccatgtgtttgtggaggaaagaagggagtatgtgcatttattcattcattcatttatacatattattcactcaacagacacaggtggggagcctattatgtaccaaggaatgtgctaggcatcagagaaatagcggggtacagaacagagtgaatccttaccctcacagagccccctcactatactggtgatgacaggcattggggaaggggaacagctgatgagcacataaatcaaatacctaagttaggtgatgggggaaagtgacatggatggaaacaaaccagggaaggggctgggaggtctggtgggtgggatttgtttggaatggatcatcatcctcactccaaaaggagctagaatttggttctttatctcgtaaacaaatgggtcttaatttagagaatccagattcactcctcaggggtaaactgcaggcaaagctccaatacctcagcggggaatgcttggagccaaaatgacatgagagtgaagtttctcttggctcctcacagcatcagtgaactctcagctgatggggtaagggaggtggtttgcacccagaagcccgggcccattctcataaggtggggatggcagtagcacttccaggagaaggtgtcggtgaagaccagaatgttctggtgtcctatcacacagtagggtgactacgtcaacagtaaggtgttttatatgtcaaaatagctagaagtgagaattttgaatgttcccactacaaagaagtggtagatgctggcagagatgggtacactaattaccctgagctgattattacacaatgcatacatgtaccaaaacatcacactgtatgtaccccataaatatgcacaatcgttatgcatcaatttcttaaacagaccaaaatgaatatgtgtccctgtgccacgggttgcctgtagaggtgcagggcttcttgctgtctgttatggaagcagtcgggccttttcccgactcccagtgagatggccaggagatctggggctcagttttcctgaaacaaagataaggacccagagtgtgacttcagctcaccatgttgttacacgttaaagcgtggtcttggtgcccgaactaaatttgaatcagctgccttctattagggcctcctttcgaagtctctggtggccaaagaaacacaaatttatgacagagtggctttgctttgtaaacttaagccctcaaaaggggacttcactgggaatctctattaagatatttatgaacttcattttttaaaaaaatagtaaatatgatcagctttgaattatttgatttattttcattaattgccagtcatccaaaagaatttattgagcacttgtaggtaccagacactgttctaggcacagatgtgagcaagatacatatggcccctgttctaatgtagcacacagtgtggtattgacacagagtaaatgggtagtcgtaacatggggctctgagaggggaaggaagcgggtatcttaggagatacttaaaggtcagggatggcttcatggaggaaggagttagctggatgaagagtggtgggagcaatgtagatgcccaggtgagagtggggccagcctggagtggagagggcattgagcacacagctagagtgtcataacctggggagggcggtttagggaggtgaaggagagagatgctagggctgccagagcaaagtatcaccgactgggtggttaaaacaacagaaatgtatgttctcatcattctggaggcaggaagtttgagatccaggtgttagctgggttggtttctcctgaggcctctctccttgggtggtaatggccattttcctctttgccttcacatgggcttccctctgttcgtgtctgtgtccttatctcctttttgtataaagacgtcaggcatattgaattaagggcccccacacatgacctcattttaacttaattacctcgttaaagactctatctacaaatacagtcatgttctgaattactggaggctggggcttcaatgtatgaattttatgggacacaattcagcctgtaatggatgcatagtcactggatcaagcaaggccttggaaccatgttaagaaacatggactttatctggaaggcaagggggagtcactgaagagtcttacacagagcggcgatgctcatgtttacatttggcagagatcttacagcagcgaggggaaaattggagaaggatagagttgggttcagaagctatgaggatgttgtctaagaaaattcttggcagagggagattaggaggtagaaactgcagaacctgtgatgggtcactcctgaggggcagagcaggggagtgtcaaggtaagctggatttctggtttgggccactgggtgcaccatggaaatcttcactgagagtcgtggtctgggtgagggaaaggaggtgagtccaacattaggggggcatgctgagtttcagggccctttgggacatctgagtggggcaggtctcaagctcctgaaataattctgggttggagatatggatttaggactcattagcttggatggtagttgaagccatgggaatggatgcgggaggggggctagccatgagtttgaatattcagaagggagctggcaactcttcttactaatgctggagacgtgtatgtgcccagaatgactaacacctccgctcatatgaaggcccagttaatcttcaagcccaggttttcctctctgaggaaccactggggtcctggggtaagagaggatcttgggtctcctgggcattttctcccttcccaagacctgaggatgtttaatcaatttttgatagttgatgagtcactggatgccttcccagctgagtcagcgaaggtacccctcctgggaagcacaacccaggcagttccaagtaccggccttgtttatcagagggatgggacgagagggtgaggtgtgacttcccagagcagcgagcttcagtgtctgactacatggggcaaggaaagacaccagtggacaaaaggtatttgctgggcttaagggtgcgtgacgcatgtttttggtagtagtagcagatttgtctttttaagatgtcttttttgagccacttttaaaataacaacagctgacatttatagaatcttcatcagcttccagacaatgtgctaagcattttacctgcattgtctcaattcgtccttacagggaagcactgtggttattccgattgtactaaggatgtgatagaagtcacacgatgtgacttctgaggctaggacatgaaagcgtctacctggctctctcagtctgtctcaggatgtatgccagggagccacaagccaacttgtgaaatgtttggttaccctgcaggtgctgtgctggagagagcatgtggagagacaccacagagagtgatgtccaaggatcctctgctgttctagcctccagatgtttggtaccaaatggagagtgagtgaggcttccaaccccacctttgagccaccccagctgatcccagtagagcagagatgagctgtccccaccaagtcttgcccagattgcagatctgtgaacaaataagaatttttgcttgaagcctctatgttttggggtacttggtcacgtagccctagggctaactgaagtatagtgagaagtgacaagattcaaggttgtatagctgcttaggggaagaacaaagaaagtacactctccttgcattcaaaggatatttcttcaatttgcttgcagtgtgacctttggcaagctactgaacctctctgtgcctcagttttctcatctgtatgatagggatgaagatggtatttcttcagaaggtagtgatgaggaataaatatctcattcttggcatgtaggaaaaagctagtaagtagctgggttggggtttcaattcaggcagtctaaccctagactctttactggtaagctcaggtccagaacattcccaccaatccctgaaaaggaggccagacggcaatatcccaggtactcccattattttcccccatacggcatgattctgagtcctccttggccgcccttctctgttcactgggccttgatacatgattctctgaactgaaggccgcaccatcactcctctctgtttagtgcagcccgagattacactggcttttttggcagtcacatcacattgttgactcattctgagctggcagtcaaaatcctaagtgtttttatcacatgtgctagcatcaagctgcattccttcccatctaggattggtgcaattggagttttaaaaaatccaactgcagaattgtttagtttattagattttgctcattgtggtagtgtgcctaggaaagaatccagatgagctcctctccagggttctcggagacaccctgtatccttttaatatacctttcctttatttctgtagtccatttgagtggcttactggtactcacaacacaaaaagtaagccatagagtgacttctgggtggtccttgctcaggaggaaaagaggtgtggcagggatgctgtggtagagggcagagaaagcaaatggcaggagcgtgtgccgggtgccacgtctgagccgtggcagaccttgcagctgatcatgactctcttttctgctgagtcaggaaatggcctctactttgattagctgccacctgaataggacagagttgaggactgaggacagagactgctttcgaagtggaccctggcataattaatcaggcttcaagcacatcggttgttcggatggttcccaattcccccaaatgtgctgccatcttaccctcattttctcagcttgcccacaaagataaaatgatatttttatcaagtctcatttcttgctgaactacaagttctctaagtggccgcatcacttgatcctgctactctggcgatactatgtacagtgcttgctgaagtggtcactctggttggtgggtgccacagaaggtgggtggctcagagtggactgaagaaagtaccagagtctgatggacctcatttctgcagtcagtggtgaggtgctggctcccatggtggggggattttcccaggtgccttagctcaggaaacatatggtgctcagtggaatggaccctggtgtgtctccagtggtctgcatagctcctgggcaatatggaaggacagtgctgactcaagcagagcctgagccatctctagacgctttcccaccttgtccttgagtcctacaaattaggtcctaattggtctgtattctccccgcccccttactctccagcctagggacgtctttccattctgggaataggacgccttacctttactccactcatattctctcaaatatgttgtatgtgcacgaagccttcctatttgcctatgcttaagctcttgaagctcaaggttaatcattaacttcttttttttgccacccctttgctttcttttatgtcagctcttccttgagggaatgaaggcagactgctgggctgaacacaaaaaggggagcagcccggggtaaaaggaaattctagaataaagagcacattggttaatagcttagaaatgttatccccctagacgagtaatagaaagttcctcaaactcgcctcagcaaattatgggaactgattgtaagaggcagcttagggaagccaggggtggaaatggctgattggaccggaagtggcacaggcgccttggggacgtgctctcacagcttctcactttgggtgccacagtctctcatctctggctcctctgaatgtctacctcatctcttctctctctggactggctttcactgcattggtggacgtatgacatgaggatacccagccctgcccatggcccaattgcaccaattagaaaagctgccccttcaagaaatattgtaattgccatctgccaggagactcagttaaaaacacacaaataagtgaggaccatacatgctcaatggactgctgctgcacgtttgtgtgcagtgatggcaagtgggacccggaactctggcctctgcttatcctcagaagtgggcggcagagaaggaggaacgtgcttgagtcgcagtccccaaaaagggaggaactcattggcccagcttaggcctggtgtctgcctacctgtggttcagtcagctgtggtcggtgggcaggacacacctgaaggagcatatcttggctgtgtgggttgggcagacatcccacaatgctcatgtagggggattcatctcattaactctgagtgtttcttcggcattcccccactatttttaacatatcatttacaatattgaattaataagactgggaatgaaagttctttgacagaacacacatggtagttacttttgggactaattgctctgcaggtcgcctcgtgcattaccgtctgctatttttgcttaaattatatgtatctgcttttatgtcacttcctaggtaaaccttacttccccctataggaaacatggttcactcaaacaaagtaaataaaagggctttcctgaaggtgtgggcagatttaagggaatctgacaagaaaagtacgagctaagaaggtctggcagccactcccctgctaagctagaacaggcaggaagggagcacttactggggccaggtggtggtagctgtagggatgtaggacagggcaactcaggggacctgtggcctcatgcagagggaggcagccaatctatagccacctatcagggagggagctgggcaaataaatgtctccatcttgttctcctccttcttctctccaatctcctgccagtgcctccactggttgaacctagctgggagccagtggatcaaagatccagtggaccaaaggatccataaatgtgatcctcctgggggtataaaaaaggatagaaataggtggaaagtggatctgggagtggctaaatggaaaatatccaggatgttccaaattgcattcctctgctatatgccttcccagaccattgcactgccccatcacaatgctcatcctagtttgtcatatctgctgaaggattaggcatgcagagcatatgcctcatggaagttaaggactgtatctgacttgtcattgctgtatgcccagaacctatccctgcatctgattatcaatgatgtgtaatggagcttggaacgtgaatgggcacatatgtctgatgtcctcacctgaccattctttgggagccctttggggatagtgaatctcccagtaccctacttgggcacaataaggactatttagtgaaagaacattcacaattgagtgaatggatgaattctaagggtggatcactttgaaaatacctgaatgtcaatctcatggtaccaagtttatatcagaattcaacctcaaattaactaacttccattccagatctgttcctttcttggtgacatggcagcatatacatgcctcattttctcctgccttatatccatatcctcttggtctggtggcacaccttccatttcttcacaagcaacctgggatgattagcttaggtccccagcccagccctactcaatggatgagcttcaactaagatggggacaaggaggctctcctgggattttgcctctcaaaaccatggatcatgtgcctctcctctccttccactttctttctttttttttttttttggcttaaattaagcagaggtgccattttttgcttatattcaaagaactcatatcctcagacaccaggaggggagttccagacttatgaggctatacaatggtatggttaaggtcttgggcattgcagctacattgcttgggcttggatcccagttctgccattttttggctatgtgaccctaggcaagttacttatgttctctgtgcctcagatttctgatcttcaaagtggaaacattagctgagataaagcatgcaaacactcttaaaacagtttctagtgcatggtgaacacgcagtatatatcacagggtcttgaccatccaagcaacttgagaagaaaaaaaaatgatggaattatacttctttaaacaaaaaagaaaaaaatcacaaatcacagaataaattggaatgaattcaatgagttttcaagggctgctatgtcttcctacccactctgatgtggggtatgtacagagaaaaacgaatctggagctgtttctaaaggagacatttgaaaatgagcttgtgcctttttatttttcaagaaaaatcagaggccagtggctatatgtgctgttctctctttcttttctgggaaagttcatgagttcttggccccaaataagcttagttctctaccgcttcccacaaggaaattaaattttcaggtcctgcacaaaagtttagttatcgctaatataatcattggtgctgtcactgtaggtctgtaggagctgagtggaaggatggaatttgacagcaataaaaaagttctccctcttcccctgctctcagacacttggatacccatttacacatatgtgcacaatgtgacacacaccctcaggcacacatgcacaaccacacacacacatacataaagggatggctttcccagagacagttatcctgagtgatgtttttaatcctgagttttatcctgagtgatttttaaaaaaactaaatccatccagtatttttgggtgcccacatagccagagctgggcatggggaaatggggaagaaattggtgctataagcatgattaaagctgtagtcctggtcctgccttctaggagattctgaagcagtgttttgggagtgagagacacctaccagtatctaataaaaggtaggttgtgaaaaggttatatgagaggttaaaaagttgctaaaggttgctttgctttctttctttaatttttaatgtgactctggagtagtttcacaggttctcagtctagctttggagtcaaccagccttgttctgcattggtctggatttaaatactggatttgctgcttatgagtagtgacacttactgagccttggtttcccagtctgtgaacaaggtacgaacatcacctgtctatatgtgttaagattgcatgtgctggaaatcacagaggttagatggcagtgacttaaccaaataggagtttgtttttctcatgcaataagtagttcagaagtgggcaagccagggttggtaccattgttccagggactcatcaaggacacaggctcccagaatcatccagagccacagggtggctgccctggttgcaggcaagataaaggggaatggagaaaatggcaggaagctgaagacgtgagccagccacatctgtacccctttggagagctttctggaaagccccattcactgactacatcttatactttgttggacacactatgccaagatgaccaacactatctgcaaaaaaaaagctgggatatcaagtattttaactgaacatatagttgcctcaaacaaaattgaagtcctgtcacaaaggaggaagaagagactccagctgtatctgccacatgatattgggagagttgttgaagagattccctgagataattcatgccaaactcttggcccaatgcctgacatgtggtgactattattattagctgggactctccccattgtcttctcagaggatcctccagcaaggtgacaaatgtaaatgcagcctcctcagtgttcagggactcccccttccaccagccactttctgtctgaatctgagtcatgctcatgactcaggccatctcatctcttccagaaagtctcccctcacctctgtggtcctccaagatatcacctgctattttcagaacctgtagcatgaaatgactatatcacccaaatgtaatttcaaacatatttcctagtgtgaatagatctatatctctgtgtttattttttctcccaactaggttacaagtatcttgatggcaggaattacattttattcctacagccctgccacaaagctctgattactggttcttatgcatctcagatgcccacactgagtagactgtaggacattctgaggtagctagcttttgtttaatttgctgttgggctgaagtgtggtgtgccagggatttgttcatgtatgtgcaataatgaatcatgctcttttgggcatttgctgtttttttaaatgttttttgaatttttttattgatatataatggggtacatgtgatattttgtttcatgcatcaaatgtgtaataatcgagtcagggtatttagggtttccatcaccttgagtatttgtcattcctctatgttgggaacattttaattcctctcttctagctattttgaaatatataatacattgttgttaattatagttactctactctgctataaaacagaacttactgtaactcaggaatggaaaaccaaataccatatgttctcacttataagtgagagctaagctatgaggatgcaaaagcataagaatgacataatggactttggagactcaagaggaagggagggaggggggtgggggatgaaagactgcatagtgggcaaagactactgctcaggtgacaggtgcaccaagggcatttcctgttctatctgcatcaattttggaagctcagatagccaaggtgttgtctagtaacatacaccagggtgaccccagaacaaagggggatcaaacgtgaggtttaggccaggcgcggtggctcacacctgtaatctcagcactgggagaccaaagcaggcagatcacctgaggtcaggagttcgagaccagcctggccaacatggcaaaaccccatctttactaaaaatacaaaaattagctgggcgtggtggtgggtgtctgtaatcccagctactcaggaggctgaggcagggagaattgcttcaacccaggaggcagaggttgcagtgagctgagattatgccactgcactccagcctgggtgacagagcaagaccccatctcaaaacaaaaaaacaacaaacaaacaaacaaacaaaaaacatgaagtttagaatgcccatctggaagcattcattcattcattcattcactcgttcaccatttatgttcccgatgtatgcgaggcacagttctgaggccctcctgttgctgtgtcacctcccacagctgcttcccatcagctgcatcccaaacataagaggagtgtgtttaatcagcaatactcactttcttctgattttgactcaagggtacttccctgcacccatcaatttcaaaaccacttcctaaatctgacttagccacttgatttcatggggtgccctgtcaaataattgtgaaagaagaacatgaagcaggactactgtgggtgggaaagccccatacttacctgccccttttctagccaactcatatcctggtcccttcggggtccccagatgaagtaccagcaacccctttccccacaccccaccagttcagtggaaaggacttatcttcaggaagattggattttatgcctcaaaatgaatgaattcagcaaagaatttctgagctcttcttacgtgtaaggtactgtgccggcatgggtgacgagaacacagctatattaacaaatcaatcaagtaactgattacatattagactgtgctagctgatgaggatactttaatctttgtaagatggatagagcactttctctgtgccaggccccatgcttaatgtcttatgtacattttctccttggatactctaaggattcacatcaacactctgaacaggttgaagatagaatgattatcctctacctgccccttccctcctgctttgtgtagaacccatcaaggagtggagagggctggagatctaaaaacaggatctaaatcctgggaagagaccacttgtctgttggggtgccccatgccaacatgaggtggcctcagttgagcagtatgctggcattttgagtggaaaggatttgagatattccccagtactctgtctctgagtttccctcaggtccagtgggtgtgtgtgagatctgaaaatgttcaatgccctgtggtagagtagaggaaggtagttaagaagtcagaaccagttatttgcatgggatcattgtgatgtggtttgaggggacactgtggcagagtcttagtatggatgagccaaaagttggggctgagagagagagcacaacaggatcaagagaaccaagtggaggccgagtcacagggaggacaacctacatttactgtgccactgtcgcatcagctgtggacactttagaagtgtgtgtgataaggaaaaaagccaatgcccagccatgacattgggtgttacctagaccagccaggatgacaggtgttacctgcctggaacagatgcccttcccaaggaaggggagaacaagtcaggagggtataacaagtctgggaacttaatttcgctcctggggagacaagaaggagaaaagggagagagagaactttcaattcaggtgaataaattactcaaaagagatgggctgtaatctcttttgagtggtgttatcttgatgtaaaaagattgatttggtttttttgtgtcaatcatagaaacagtttttccagaattgtgactgtgaattttatacccacaacaggagtttaggtgaaaatatcctcaactattttcttttctaatcttttgctcttggcttccttctcagagtgcctcctcataacctgacgcacctgccaggaccaaagtagatcttaaacatataaataatggctgaggtttcatccttagactgcatggtttcccccaggggagtacatatttatattcttcttttaatcaatggagaaaccagaggatgactcattccctcagagtggaagaggaagtcatggtgcccttgactagagtccctccgggttttggtttcttctcggtggggttgcagcagccctgtaaggaatgcatgagggaagggggcaaaaggtgctgggaagagagatggtggctgtttggacaaagggctctttctgtcagtggctccatctccacccagactcaggctcccgttcagaagttcagctctcttcctttcacccactctgagattcacatgctcacactcaaagctattccctcaccaccagggctgggagggaccctgcctacaagccctttcctcttccagatgctgaaagaagaagtaattatagaaaacaaacaaaacaaaacaaaacaatggcaacactatggagacagtgaaaagaccagtggttgctaggggttagcctggagagagtaataaataagcacagtgcagagaatttttaggtcagtgaaactaccctgtatgagactatcatggtggatgcatgtcatcatacatttgtccaaatctacagtatgtacaccaagggtgaacccttatgtggtagtctcccttatctgaggttttgctttccaaggtttcagtcacctgtgatcaactgtggtccaaaaatagtaaacaaaaattccagaaataaacaattggcaagttttaaattgcacaccattctgagtggcgtggatgaaatcttgagccatcttgctctgtcctacctgggacttaaatcttcccttggtccagcatatccacactgtctatgctacccactcgttaggactgaaaaacatattgtgtatggggttcagtactatcccaggtttcaggcgtccactgggggtcttggaactattccttggggataagcgggcactactgtatacattatggactttgggtgatgatgtgtcgatggaggttcatcagttgtaaccaatgcaccactggggtgggagatgttgataatacaggaggctacgcttgtgtcagggcagagggtgtatgggatattccgtaccttcctttcaattttgatatgaacctaaaactgctctaagaaattaaagctttaaacaacagcaacagtaacctatcctatagaaagcagtgggggcagcttcatccttccccttctcaaagcataaaataattgcacctaatttttttttttaaccaatgaggtatctggggaaattgaaatggagagatcctcatggtgtagattcaacttatggaaactcaatataccaacttacaagccggatcatttaggaggtgatactttattttataggcaactgcattacttcaacacaggattcctatcaacataattccctaaggcatttaagaatttgcttatagatcatgactattttagagaaagcagaggcaggcagaaaatcattttggagccatcatctgttataattctggcagaagtaaagtaaaaagatgaagtatctctgaaatcaagtaaatcaataggaaaacaggatggatttcccaaattcaatttatacacaactttttatagcattataaaatataggccgggcacagtggctcatgcctgtaatcctagcactttgggaggccgaggcgggcagattgcctgagcttaggagttcaataccaggctgggcaacacggtgaaaccccatcactactaaaatacaaaaaaaattagccaagcctggcagcgtgcacctgtagtcccagctattcaggaggctgaggcaggagaattgcttgaacctgggaagcggaggttgcagtgagctgagattgtgccactgcactctgcctgggcgacacagcgagactccatctctccaaaaaaaaaaaattaacctttccaaagactcaacgttgactatatatgctgaactagacagtttatttgcatgaatcctcctaacagccatgagaggtagctatcagtctcctcattttatagatgaataaaccgaggcctgggatagggaaaagacttgtcgaaggtcacagatgtttcaagttcgtattactgtagtccataaatccaactgtgtgtgtggctcttttttgggagcatggggaacaaaacacaaggggctagtcagcattcactcctctatttgaaaaatattctttaaaaaggaaactatttttggatagggaattaaagagtaaacatgagtctctgctagtttattttcactgagtgcacacactcctccaacgataattcattcaggatgtgagctggaactcattagaagtcaccaggcctgggggagtagataaaaccacgattaaagacatctgagccctttaggacaatttattatcttggatttcatatttaataggagacattaattcacaaaagaagtcctcagggcaagcaaataatgccctataattgctgtagggctctggggtttccaagcatgcacttgctcctgggctgggcgaggtcctaggtttgctgggaggttccaggcccaggaactcctctgaagctctgtcagtttggcattgcaggaggaagagctcttgccaaaaaccagaacatagcttcaagttatttgttataagttggctatttttttttcctcaaaagcctctccattcatgccaatgggaggggaaacaacccagtagataggtctgaagcattaaaacaggtgacagagtggctattcttttttttttttttgagacagggcctcactctgtcacccaggctggagtgcagtggcatgatcacggttcactgcagcttcgacctccctggctcagacattcctcgcatctctgcctgctgagcagctgggactataggctcaccaccatgcctggctaatttttgttatttattgtagagacgaggtctcaccatgttgcccaggctggtcttgaatccctgggctcaagggatccacccgccttgacttcccaatgtgctgggattacaagtgtgaatcaatgtgccaggccaagagtggctattctgagagccctgttttccatggtagcgaagtgtgtaagaatgatccttggtgggcctctggtcccctgtttgtgaaacgaagagtttggatgacagagtctctaaagtccttttcaaatctgtggcagagttagagaggcagagtggggaaaagcgtcctggagttcaaatccctgctcagtcccttcctgcatgtggaatgttggaactataatcacaataccagcaaaagagtgttgattatctactaagtgccagacattatgctgaatcctagaaacactgaggcgatcctatgaagtaggtactgcaatatctccatttcattgttgaggcaacgggagcataaagggactaagtgacttgcacaaggtcatatggagcaggatattttggatccaggtagtctgacttcagcatctgcacttctacccaccaccatcttcacccataagatgggataactgcccaccttatagcgttatagtgaggatgaaaggttgtcctgaatcaaagtgcttagcatggatagttcctgacccatagtaatagcttgtgaagtaaattgggtttgtttaactggagaagctaatgagaataggagacttaattattgccttcaaatatatgaaagatttttaatgattcacttatgtttgatgaatatcaagcctccacagagccagactaaatgctttgtattattcttaagtctgtgtcatccaggaagaaaattcaatttaaacaggagaaatttaattagacataaaaataacttgaccttcatactgggtataaaatttcagaataaatgattgcaattagctgtgaagtttgtatacatgatgttgaaatagagaattactatttgaaggcctgccatggacaattgtgcaagttgtttactgcacgtaaccagggactgccatttacaccatagtctatgtgaatggtaccctctggagatgtgcaatacataatttgcatatccttttatcctgactattaaccctgaaatgtttagattgaggctggtcccattctagctgtaggaatccatggctttgaatgaaagttgagagttcagacaattatctaagaaaggtaaatatgtgttttgtacaatatgactcaccactcaggattccatggcagtcacagatagtagaccaaggcctcagaatcttctcaatgcaacactccagggaattgctatcaacaaatcagatctgccactttatctaaaacacaaaagctgtttaacatagtgatcagaagcctaggctggagctataatgactgggttcaaatctaagctctgatacttattaaactgatgacctttgaatcagaaaggaagcattttactgcaaataatagaaaccaaactaaaagtgtgttaacaataagaaaaaattgttagccccctttttataacctaagaagcatgcacacgtgtgtatacacacacatacattttatatttttaacatctctgatatgaggtatgttatgcaattgctgttgctaagcattgcctgcccttgtgcttcgaacctgcagaatggtgatggcctcttgggaacaactccagagattacagaagggcactttcttaagaaacacagcatcaccaatgttcttcatgttacagaggacaagcgtatgtggaaaaactagaacattgataactctgattggacaagtgattcaagagagtttgactcaatgtaaagcagatttaggaataccttgactaatttactttatttatgtatgtatttatttatgtatttatttatttttggagatggagtctcactctgtcatccacgctggagtgtaatggcgctatcttggctcactgcaccctctgcctcctgggttcaagcaattctcctgcctcagcctcccaagtagctggaactacaggcgcacgccaccacacccggctaatttttggtattttggtacagacgggatttcactgtgttgcccaggctggtctcaaactcctgagctcaggcaatctgcctgccttggcctcccaaagtgctagcattacaggcatgggccactgtgcccagctaaatttactttaaattagtaaatttatatttaaatttaaatgcacaggagtgatatgtggtataaaaaatctaggcataagtaaatctaaatggactttttcattagctatattcaaaaattctaaaagtatattctaaaaatatattctaaaaattctaaatgataatatagcatcatagttaatttgacagcattacaattttttttagtcagagacaatgtaatggtgcatctcacaattgatggcatcttaaatgagaagaaatgtggcatatcatattacaaggccagagaaaagacagtgctggggttggccaatttggcagcttaataacattgttaaggacaaatttctttttattcttttaggctgtcatcctccttctatcagcttgttctttgagctgactcctcttgttactggctgggaagtcttgactatgagttgttcaggttcttggcacattgagcaaagaattgaacaaaatgcacaaacaaagcaatggaagatgaaggcacagatttgttaatattaaagcgaaagtatattccatagagtgtttgtgggcttgagcaagcagctcaagagccttgagtataatgtcccctggggtttttattaactagaagaacttaataacaccctttagaggcttccagttggttaaaccctatgcgaatgaagaattggcctgtgaccaatcagaggctagagcccctatgcaaatgaaggctttgcctgtggccattcaaagggctaggtaaaggctgggctcatggccaatcagaggcatttcctatttgttgacggggaaaggagttttgctgagggaggggcctccagcccattttcacctgggcatggagaggtggggttttccttttggttcaattctaagaagagagccatgagttgctcttaagctccctgtctctagaccctattctcctaccttactctcatgattctatgaagactgctgcagttctaggtactccagacagatgacaatgtccagagacagaaagaaagtctctctcatgtatctccttttagtctgcaaggattcctagcagacttcttttcatttcttcttgtgtacaattgtgtctcatatgcataatcatgaccaatgcgaatgggattaccattgacttaagccaattatgacgtccccctgggcctagggtaggactccactcccctgcaacacacgatcctctgaacaaaactgaggttcttctagcaaggagaagacagggagaatgactatcagttagtcaatcagaagtatccaccatactccgcaaattgcttatcttttttggctttagtattttcatgtgtaaaatggcaatagtaataataataataatgacaactacctcaaagggtagtgaggattaaataatgcatgtagggctgagcacagtggctcatgcttgtaaccccagcactttgggaggcctagataggagaattgcttgaggccaggagttcaagatcagcctgggcaacaaggcaagaccttatttctaaatatatatatgtgtgtgttttatatatatatatatatatatttatatatatgtatactgcttgtatatatatactgcttatatatatataaactgcttatatatatataaactgcttatatatatataaactgcttatatatatataaactgcttatatatataaataaactgcatatatatatataaataaactgcatatatatatatatatatatatatatatatatatatatactgcttagaatagtgcctgatatatggtaagggctcaagagatgtttagcattgattgatactgttcctgttttcactgttgttatcattatattaccctatatctagataggcaaagtctcaacctgccactgaagaaaaggaaaatgagggcttaaactagccttagatattagtacagatagtcgttggtcaacagacttttttcttgagcaagtcctctatactaggtattgttcccaatgtagaaagaattcaaaacacagctctgaggagtttatgttctggttgtagaggcaactagagagttggaaaaaaaagtagagatctcttgccttctagcctcttcgtatactctttcctttgtctgaaacacaatttatcaccacctctctcctaccttagcctggtgaactcgtattcaccttattacgtcagcttaattgcttccctgaccccagattttaggtaaactgtctatgcgaatgctttcataattgccatcataatagcaatattatattgaagtgtgtcagtcttttgtcagtcttcccactttatgtctaacttccatgagggcagagactatgtctgtctgtttcatgactgtatctcctattcacagtgcctgatacaaatgtaggcaggcagggtgaacctgttgaataagggagtgaataaaggaatgtgtttcacttagaactctttctgttgtaagtgacagatataacctggtttaattaaaaaagagatttataaatctcataactgaaaagcccagaggttggtctgatttcagtcgtgatttgatttaggggactcaaatgatggcattaatattctgtcagatctgccttttccagtgtgggtttcatttccaggcttcccatggtgttcttggcacttccagagtctcatctttccaattcacctacaaaggcaaagaacatatgcctctctcccaccagttccaccaatatgtgattctcactgggtcacatgcccatcactgaaagagtcactgtgaccaaagctggacttgaggtgggatttttctccacggagtacgtgtacggtaaccttacatgttacctgagagtgcgggatgtagtgactcccagggataagtttgggatattataattagaaatggggtaaatagatgccggaccacaaaacaacagatgttcactatagaatgaatgactgaatcatacaggaccatgtgataaaatcagatgtagagaagaaagtcctgcagaatttgtggtaggatagaaaaatgcacccgcccctgcaccccccacccccggacttgttaatatattaccttacatggcaaagaggaatttaggttgcagatggaattaaggttgctaatctactgatcttaaaataaggttatctgggattgtttggatggactcactgtaatcacaagggtcgttaaaagggagaaacagaggtacaagaggagggcagagtgctgtcatgtgagaggaattcaaccctctgttgccggccttgaagatggaggaagggggccatgaactaagacattcaggtagcctcttgcaggtagaaaagacaaggaaatggattttctcctagagcctccagaaagaaacacagccctgttgacaccttgagtttagcccagtgagacccatgttggacttctggcctagagaattgtgagataatatatttgtgttgttttaaaccactacatttgtggtaattggttatagcaatcaaaaactaatggcgtttaaacaaaataacagacagttctcatagaaagaacaaatgaatgaatgaatgaatggtacaagaccatgtaatgaaatcagggatagagagaaaaatgctacagagtttcaaacagggagagctttttgttggtgtagtcaagaaagggctctcagagaaggcaggatggtagctacagtattttatgagcttcacacacaaaaaagagggatttggggctgagaaaagtggaatgttcaaaggcaggaatgaatcaacacattgggaacttcactgaaattgcaggttgtggtgggagaagggtatgagatggggttgggtaggtaagaaagggggtctgatggagcttctgcaaatctgggaggagatgtttccatttattccagttagccatgagaaggcagtgtaggttttgagcagaagcctatcatggtgcacacacacagaggtgcccaggatgaactggggacaaaggagaccagagatgagccaggctggcaatgtggaaatgctgggtaggtagcctgtctgcaggatccatgggtgactctctgcaattgagtagaaatgggagtgaaaattacaaagaaagcagagaatcctggaaggcagggaatcttcacttggggctcatgggtcctctctcctctgttcgtgatttcagggagtcaatgagactcccaagattagatgcacagttaggggttttgtgagtttttctggggagagggccacatcctttatcagattttcaaagggctctgtgactcgagacaggtaaaagtcactgatgtaagtttaaaaaatatgctttattgaagaataatacacatgtagaaaagtgcacatgtcataaatgtacagcttgatggacttgcataaactgaatacccctgaggaaccagcacccagataaaaaatcagaatcataccagcactctagaagttccttctcaagccctgccctcttcctgccacagtaaccactgctttgattgctaactcagctgtaaggtattaagccagggctgtatcatgttcgacctcctagaaattggaccaccattattaaaagcaactataggctagaaaacacatattgtggattttctccaggggatttcagatagaattggatgagaaaaccactgtggtgctttgcaatcatccccaggttgttttgacactgggcaggactgctccaagcagtttccttccctgggtttctaaccctctgacatgcagccaaagctgtgcttcccgcgccgggctgaaaatctctgtgcttcactccatttgctgcattagtcaccgtaatcctgggggctgggccacgggaagaacaaaatctaatttgggcatttcattttatgagttgatcattatttggtttcctttcctggttcagaatcaagggccaagaacacaggctcttaagtacatagttaccatggcatgtttttatgctgcagcgagtggctaaaacacattggagggtaagaggattagacagcaaatggcacccgctaaatgtgaagagcgagtcatcctgcaagggggttacagtgcactccagcaggcccgatgctggaggggacatggatgggctataatagggttcagaactgatctatttgcgttttcaaacaacagtcaagtgaataacagtaactggattacagattcggcttctgcctaagcacataaaagcagagaacccaaaacaaaagaaatgagacaaaggttttgtggtatcaccaagaattagggattctggcaggaagaagaaccccccagaaagaaattaaatttccttagagaaacagagagggagggaacataaccataccctccttggtcccattcctggtgcccccacccttcccactgaccacattagatatctctgaggtcagagaccattgcaatgggttttgtgggactgccctaattctcgagtttggttgggattttgtggcattgatttccgttagatttgacatcgcctggcctctcaaactctttttgttttggaaagcgttttattatgatggtatttattctacttggcagggcctcactctggagaggtctgtgaagaaagtgggatttgttggtatgacttcttccccaccctctcttggccaagcccttcttctctttgcattttccttccactgcttttcacatttctgctgtctctctctctctaaccccgaactggccctacaggccaaggaatcgccagccttttccaggacctgagctgagttttcatgtaaaaaagctgtcacagaaagagatagtacttttagtgtcacctgcttttttttttcttctttttttagaaaatatatggtcaaagctaataggatctcagaaaagcccttaaaatgtttattttccctaattataatgggaaataaataaaatatatttatattaccataaataacatacaaaatcaaggtgctttaatataaaaaaatcaagatgccctgaaaacttccatttaaatgtcacagagtgaacagatgtattaattttggtttcttccccaaactcagctaaaatgacattgattgaatgaaggtggtaaaacccacaaagacaaagaaagtgggaaaatgagagaagtcaacagaatgcaagctgggatgcagaactcataagggtcttcttagagccaaaggaaagcctgggaggcaagaggatagagaatcataaagagcaagtcagctcaccccacagaacctctggcatcttaggaattggaggctcagagctcctctgcaagccaaggtgtaggtgggtctgaacataggaggatgggtttaagtctgattaaagagcaactggggctgggcgcggtggctcacgcctgtaatcccagcactttgggaggccgaggcgggcggatcacgaggtcaggagatcgagaccattctatcctggctaacacggtgaaaccctgtctctactaaaaacacaaaaaattagccgggcttggtggcgggcgcctgtagtcccagctactcaggaggctaaggcaggagaatggcatgaacccaggaggcggagtttgcagtgagccgagatcgcgccactgcactccagcctgggcgacagagcgaaactgtgtctcaaaaaaaaaaaaaaaaaaaaaaaaaaaaaaaaaaaaaagtaattggattctcagagtccatcccccagcctgagcaattaggcaacttgcctttccttaatccagcagaaaacagaatgtgtcctctccagagagttgaaactgagacattctgggctcaggacacagctgggcacagagacagagaacatcacatgtgctttattaaaagcagggggattaagtgaaagatgctacactgaatgtggaggactccagctgccttccagcgctcagctcccagaatgcagcagccaggctcaccgcactacacattagattgttgttctcagggaaagtagaccagcacaagaaaagaatcccacagttactgccctttgggtatccccagtggagtggtggtgggtcctttctggtcagtatttctctcttaagtcaaagaatagccaaaggctcccctcgatgtagtcaaagactaagcatggcttctaacttgaaatgtagatagcaaagtaaattaacagggaaaataaaacactgagaaaacaaagacaatgcagtgaaaaaaagatttaaaaaatatgtcagtattcactttgggaggccaaggcaggcagatcgcgaggtcaggagattgagaccatcctggctaacacggtgaaaccctgtctctactaaaaatacaaaaaattagccaggcatggtggcgggcacctgtagtcccagctactcaggaggctgaggcaggagaatggcgtgaactcaggaggcagagcttgcggtgagccgagatcgcgccactgcacaccagcctgggcgacagagcgagacttggtctcaaaacaaacaatcaaacaataagtcagtattttcttcatagagataaaacattatctctatgaaacaataagaggatggtatagaaaaggaacgagtttttctcccagctttgttgaagtgcgattggcaaataaaaactgtatatatttaaggtgtacaagatgatgttttgatatacatatactttgtaaaatgatcaccacaagcaagctaattagcagccctcacatagtgacctttttggaggtggaacgcttgaggtctactctcctggcaaatttcaaatataaaatacatttctaactataggtacaaactacatttgtaccttttgaacaacatctctttctccccacactccagtttctgatagtcaccattctactttctgttaatatgagttcaactttttttttagattttacatataagtgagatcaggcagtgtttgtatttctgtttgtcttatttcacttagcataacgtcctcctggttcatccatggtatcacaaatagcaggatttccttctttttaaatgccaaataacattccattgtgtacatataccacattttctttagtctttcatctgttgacggattcttaggctatttccgtatcttggctattgtgaataatgctacaataaacaggggagtgcagatatctcttcaagttagaaattttacttcctttggacatatacccagaggtgtaattgctggatcatatgttaataatacttttaatttttttgagagacttccattctgttttccacaatgactgtatcaattttctttcccaccaacagtgtgcaatagtaccctttcttacacacccttgccaacatttatcttttgtttttttgataacagccattctaacaggtatgaagtaatattttattatagttttgatttgcatgtccctgatgattagtgatgttgagcatcttttcatatacatgttgaccatatgtatgccttctttggaaaaatgaccattctggtcctttactcattttttaattgggttatttgttttttggtattgtgttctatgagttccttacacatttgggatattaactatcttgctgttttcctttataatttgattattttctgtagtagtgtgctttaattcctttgtatcttttgtgtattaactacagatttttgcttcagggtcacaatgagacataagagcctatttaagccaataacaacttaactttgaatgcatacaaaaagtatacttcccctccccatttaatgtatttgatttcataatttacatcttcttatattgtgtatctattagcaagttattgtagctatagttattttaagacttttgtcttttgacctttatgctagaattaaaaataatttacacatcttgatattacaatattagaatattgtgaatttggctatatacttacctttaccggtgggctttatactgtcatatgtttgcattttattagttagcagccttttatttcaatttgaaaaactccctttagcatttctggtaaggcaggtctagtggtaatgaacttccccagtttttgtttgtctgagaaagactttatctcttcttcatttctaaatgatagcttttctagctaaagtgttcttggttgcctttttttccccaacactttgactatatcatcctactctctcctggcctgtaaggtttctgctgagaagtcctctgatgatcttacagtgttcttttgtatttggtgagtttcttttctcttgctgctctcaaaattctttctttgtctttgatttttgaagtttttattgcaacaggtttgatgaagtactctttgggttgaacctgtttgaagacatttgagcttcatatacctggacgtccatatctctccccacatttggaaagttttcagccattatttctttaaataagttttttgcccttttctcctctcctcctccttccataagacttatggaacacatggttctcaacttacagtggtccaacttaaaacttttcaactttatgatgccatgaaagcgatacacattcagtagaaaccatgcttcaagtacccatataatcattctgtttttcactttcagtacaatatttaataaatgacatgagatattcagcactttattataaaataggctttttgttagataattttgcccaggtttaggctactgtaagtgttctgagcatgtttaagatagactgactgagctatgatgttaggtaggtcaggtgtattaaatgcatttttgacttatgatattttcaacttatgatgggtttattgagacataaccccattctaagtcaaggagcatctctagcaattctcttaatggcatcccacaaattctgtaggctctcttttctctttctcattcttttttcttttgtgacaggataatttcaaatgacctgtctttgagttcatagattctttattttctgcttgattgagtctactgttgaaggcctctattgcatttttcacttcattcattgtattgttcagttccagaattgtttttttaatcatttctttttgttgagttcattgttttgttcatgtgttgtttttctgataatgttgagttatctatctcaacaaagagaagggttattctcttctagctcactgagcttcctttaaacaattatatcaaattctttttcagggaattcatagatctccattcctttgggagtggttactgaaaaattgttcctttgttggtgtcatggtcctttgttagtgtcacaattattttctgtgttccctgaagtgttaccttgctgtctttgcatttgaagaagcaattacctcctctagtctttactgaccagctttgagagagaaacaccttcaccagtcagtctgactagggattctgagactctctcctaacttttatatgaatattccccctccacacctcttgttctgtcttggggggtgaattattaagattctctgccttctcttggtcctgcagagccaagccaggtgctgagatcctctcatttgttttcccaagatggtgccctgaaatactcaactttgtgtacttttttcctatcttgccaagtcaggctgtctgtctgcatgtacttgtaaacctcctgctgagatgcacactttcagtccatgaggccacaagtgggaagctggcatgggggtaggggagatatgtgaggcatgcataacattgcagaggcctgtgggccagctggggagtctgcatgtgtgttgtcccaagtagttttggacaagcttcctgatgaagttcatgaagcagttaataaaaactgcatcccttttctgaatactgagtattggttgctatgagtctcttctcttctctactcgcaatctctcctaactgctgagctctaccaaccaccatggtactttgagtggcaaaagaaaggtgcagccctcttgggcagcattccacatgactggggaagccaggtactcacttcctatgttctcagtttctctcatgggagaaatcacaggctgagagattctctctttgtactgagctgtactgtcctaggagaggagtgacatgggtatagtgaaattttttttcttaccctctttagtgtgcttttctcagattttttttccccaaaagtgtgttggaacttctttgctggattctcagactcccacaaaggtagtatgatccattagtcgttgtcaaaagtgatgctctgtggggagataatcgtagaaaactcctatttcaccattttgctgatgttacttatactgagcttcttgagagttaaaaatatggtaacaagaatagaagtttcaataaaagatctgtgtgataaagtagaggaaatattgaaagtaggtagaaaagaggagagaaaagctagaagacaaagagaaaacagaggagatgtatgtaggaggtctttcatttacttaataaaaattctaaaaaagggaataaaaaaccaaaatgaaaaaataatacctaagaaataataaacatattcaacaacagatggacgtgagtttctagctggaaagcatcaaccaaactgttcaaaacaatgacatttaaagggccctcacaaagcacaatattgttaaattccagaatgccagaaatagaggttttaaagctttcagagagaagaaataggtcatatacagaaaagagaaatcagaatggcatgagacttttaaacagctaccttggaagttagaagtcaatgaagtgcccttctattactaagggaaaatgactttcattctagaattgcttttccagataaactgtgaatcaagtgttaggattaaaagatgctttccaacatgtaaggttttaaaaatgttacatctcatggtaactcttctcagtttgtgttcaaccatattgagagaataaaacaacaaatagaaaatcatgggatactggaagtgggggatccaatacaggagagagctgaagggaattcccaggctgatggtgaaagatggcccacaatgacagctgtttggcaggtctagaaacccattacaggttgaagggaaaaggtggaagtctccacggtggatgttcctaagaagagtggaactgagagactactaatggattcaggtatattgagagaaattcttagggctccatgggagagttggggggataaattagtgacaggcacacagaaaactaagcaaaaaataatgttaatcccaatgacagcaaaaacaaagacaattccagaaaaaaaccacaaagttgtacaagaaagaaaataaagtcatagtatagtcacttcagtgagtaatacatagttacagtattgggaatggtgatgttgaaaatttagttacaatgttagtaatgctagtattggacatttaagtatttttaaaaatacttaacaaaagcatgatataaatgtgttaggagaacagagagagaggaagggtatgtaggaaggggatctgtgtgggaatgttaagaccagagtagaaagtcaatcaatgaggtatgaaatgcaaaaatcagaacgtactggtttacaaacattatttttatatatggaaggaaataaccaagagaaatatcccaaagctgaaagtgattggccctagagagaagataagggttacaaagagaaataatgagaaatcttgtttttccagtataaaccttgtagaactatctgatttttaaaaagatgttttatacaaattactctgataaatttaaacttaagtttaacaaagggaaataaaagcatcttctaatctcactgtctgcatattaattgtaaatagtctagtgaatattcttttggactttgttttctatgtgtagtataacagaaatataatttttaattttcccatgattagatagtactatgcaaattgtgttccatttctctttttcacttgtatcttggatattttttccaccttagagagggtaatagtaatactttttaacgagttatgttttactagtcacaactgcaactttttgcattggggaaatagcagtacctataagtagaagaataattaggggctccatttctttgggccttcccttcagcttgcttaacattgggtatcatttgttcaaactcctacttaggtgttaatcaataagggcttaataaaatatgactttttttttttttttgagacaaagtctcactctgttgcccaagctggagtgcaatggtgcaatctcgccccactgtaacctccacttcccaggttaaagctattctcctgcctcagcctcccgggtacctgggattacaggcatgcaccaccacacccagctaatttttgtattttgagtagagatggggtttcaccgtgttggccaggctggtctcaaactcctgacctcaagtgatcaacccgccttggcctcccaaagtgctgggattacaggcgtaagccatcacacctggtctaaaatatgacttctcccagagatatttatgacttaatagataactcccgaagattaaaggaccttataactttaagaatgagctactaatgaggaaattccaggtactttcatagaaagtagaagagatcatttttgggtagaggatatccattagatatcttctctctctctctgtgtatatatatattaaatatataaaaagatatataatatatataaatatataattcatacatatacattatatataaaatatatgtaaactctatgtatatttcaaatataaaaattatatattataaaattatatgttatatgtagcaatttatatatatatatatatatatttttttttttttcctaaccctgcttcctgtgtgagaaggggaactccctattgtgggtgccctgccccccactatgaaaatccttcctctctccctgtaaccacagacaactagggcatgggcacctgctccagtcctgacacccttctgcccagggctttgatcttgagagagcaacacagaaatggacagaggctcatgttttgtggtggtatgccatgacagcagttgcatcccccctcttcctcccatttttctcatctggtgtccatgctgtcatccgttgctgtctgttcctgctacccaatctctggctttgggggtgggtctctgccgtcctagtacatctccatcttagggctgagcagaaacctagctcttccatgtccacagtgccaagaggcctcgctgcagtgtctaaggagaaagtagcaatgactggagacagtggaagaggaacacacatcaaagaacaatactgcacaggatagaactgcctttgggtctagggcagatccatcttgcttaagacctgcctttatgtgactggcagcagcaactatgccttcaactctcccctctcctggaagttctctagtcatcttccgtatcgatttcaaaccccaaacagagcaagaagtgtttccctcatagctgtataaggactggcctcttcttaggatgaccggtagtaagaacaccatttctctttaggggaaaccccaccctctctgcagagctttggtcagaccctgtggctcagataagactatcacaaaggagttttagatgggtacctttcctgaactctggggaattgagtcttatgactaacactttgccaccctaacaagaaagatgcaattaacaatgctgtttgtgattagcagttggtaatctgtcactcaacgcttgcacctgcctatctgatggaggaccaatacacatgctcagtaatcatagtcctaatagccaaatgagtacccattattcacatgcaaaaattctggctgaagctggagtagaatacatagcttaggtccaaggccgataaggcctttccttctcatcctcaatctaaatcctgggacctccatgctcaggcatgtcaataggtagtgagagacaaggagcagacactgcattcatttgcccaccagtgatgtgagcaaggatggcaggcttgcctcaaccattcacctgtgggtgggccaggagagcccacacgagtaacactgctcatggtataataaaatgtcaaaggatgatcaatcagattagcttctcctcttttcttccctctctgtggaggagttgggtaaagggtggagggatagaaggaagtatgtcctttcaggaaaacaaggaggaagaccttccctgcaacatctaacagtgtctggaacacagtggctacttagtaaatgcttattaatgagaagcagcaaatgatcagattctaatgagaggcacaaaaagaaaaggaactcagagaaggcttcttggaggagagggcatttagagtcatctcctccatccttctgtggcctatctgcatctggggcacagcccatgtaagcttcagtaattaaaacgttttcctaagtagctaattcacactaagagatatgatcatgaagtattactacctgtcattactttggttggatgttggctaggacttttggatcaattagtaatagtcatggaagttggatacaaataatgatatgatctgggatctggatgttcttaaattttattccactaaaattataaaactcaggccttctgaaagattattgacaaaaggagaggaaatctcaataaagcctccaggtacacttgactaacaactgaatcatatccaaaaattatatactatgtatggaggctttcaacccactgctcttctcagtaagtcacccctgcagccagtccacacccacacacagattttggatgacaggtggcacaattgaaaaaagtgggtgtccatagagtcagtggcagaaaggaagaaaggcattgaggtgggagcattgtgtatgcagaaggagtgtgcaagaaacattcaggggatgatgagcacacccatttggctgactagttaatctgctcattaatcgctctgcctctctgtcaaaaggaagcatttcactccggtcctgagaaattgccttcctaaggaaagaacgttattgatggaaatttaggggtgtttggggaatattactaaaatttgtgtgtaaccaaatttgtgaccttctaacaaatgtccccctgtagacctgtgagaaacaatattagggttgacccactcagttcatgcttttttttttttctgttaaaaaaagccagcatttcaagcagtgagtagaccagtaagctttaccccaggccttataggtcaacaaacctgcaccagggatccaaatctttctcagagtgatcataccactgtgttagagttcttcagagaaactgaaccaataggagacgatatagatatgtggaaagacttatgaggacttgattcactggattatggaggctgagaagtctcattatctgatatctgcaagctggaggcccaggaaaaccagtgaggtagttgcagtccaaacccaaaggcctgagaaccagaggggccggtggtgtaaatcccagccagagcctgcaggcctgacaaccaggaacactgatgtctgagggcaggagaagacagatgtcccaactcaagcagaaagagccaatccacccatcccctgcctttttgttcttttcagatccttaatagataggatcatgcttacccacagtctacagatccacgtgctgatctcctccagaaacaccctcacagacacacccagaaataatgttttatcagctatttgggcattccttagcctagtcaggttgactcacacaattagccaacataccaacctcacacttatttatttatgtatttatgtacttgtttatttatatttttagaacttttatttgaggttcacaggtccatgtgcagttttgttatataggtaaacttgtatcccaggggtttgttaaacagattatttcatcacctaggcactaagcctagtacccaatagttatttttctgatcctctccctcctcccaccctccacctgctaataagccccaatgtctgcttgtctcctctgtgtatccatgcattctcattatttagttctcacttacgagtgagagcatgcagtatttggttttctattcctgtgttagtttgctaacaatgatggcctccaacttcatccatgtttttgcaaaggacatgatctcgttcttttgtgtgactgcatagtattccatgctaacctcacacttttgttgttagggcaggctctgggagctttgggataaaggagacctttaaaatttgcccccttcatttagtcatactagatacagagcctctaattggtcaacaggacccaccagccgctccctctccatctctatactcaggcctccttagcttgtgctgtggatgagcttccaccacatggcagagggtaaagggggggtggccacagtcagctccaagctcatatcaaccaagcctagcaaccttgggagaaaaacaattcccccaatccatttcagaagatttagaaatgtggaaaggactgattactatggcttgggtcacttgcctatcctgtgaaccaatcaccttagccagggaaataaagatgggccatgcactaattctctcagagggatcatcagagttggcagtcccatcagactcacatgggaagcctaacaagggggcagtgatcccatgaacggaggtgtgtgtgttgagcaaggctgttatctgaagaaccagaggagagaaatactgataaaccaaagtagcagatgtccccaaactgggaaagctagaaaagagagcaatgaaatttagaatgaaaagtaagaagcagaacttggagaaactcccaagtagaaggcaatacgttcaaaagattttagggtactggaggttttaagtgtgtatggggaaggaagctgttaatggcattggccaggccttgacactgctggaaaagtgacttcaagagccagtcacacttcttatatgaaggtcagtagactctttttggctagaagaacaaggacactgacctgtggggacatcgtggttttctttttactaacttaagaataaagatgtcagggtttctttcccactgcagtgggaagtttctttcccatggctggagatcactgaactggtaggaagattgccacgttggccaaaggaaatctgccacttttgtttaagtcctggagatactcattgcctctagaaaggtagtccgcattatgatgtggtgagctctgatggaacaccatggatagggagtggcactgaatctttagaaactcaaaagtgagcaggggaaccagagggaagtttggatcgactgaaaggacagtctgctgagttcctaggaaagggaagtaagtgaaagtgtcattttcccctgacatatctccaagataaaattttgatgtgatgatactgatcaagctcattaatttgtttggcactggttactgaggttgaatgatggagactgcttggagtattgtgttaagaagaattctgaagcagtattgggctcagccaggaacagtgctataaatgacaaagcaaaacctggcagtatcatagaaatagaacatggtagtatgtatcaatcatatttgccttccccagggaatctatttcccgaggatttctcccaggaaactattacaaaggaagaaaaaaatgctatatgccacaaagatgttctccttggtgttatttaccatagcagcaatttgttctgcagaaggagaatggtcacttgtcagaattaaattgttgatcatgaaggccatttgaaaacatgggaaaatatgggacataaaaagctgagtaaaaagaaaacatttatatacataatatttgcagtgagataaaaaatgacatatcacacacacacacacatgtatttttgtgcatctagggctcatttatttcatattcacttgtgtttgaaacccagctgctattatcacacagtaggtacacaataaatactttcaactattttgttgctagctttacatatttttttgcgataaaaatagcttttcccaaaaggaataaaaactaaaacaaaaaattcaaacatccaaaagttaacatccaaaagtgttggtttttcttctcagaaatagcaatttgttctgcttctcatcagtcccacttaggctctctctaggacttaactgagcaactcctaagatccaagttcccttaaattcctacaggcagtggtcccaccaacaaagacttctctactcttcctttgcctccagatgctcagacttgggcttctggtattctgaaagcatccttgtttattttcctaccagagattgttgatttgccccaaaggaagtttttttcttccattttgtgtagtgtgagtggtgactaactatgagaatggtctcaatggcatctctgaggccagaggaaagcttctgatgcaattcaaaattcagatctgaagcctatgaatatggttactgggcgtgatcgacagattgaggccaggtatcaaacagatctcagatattgacagaacctctgctcattggaatgacctctcactatgagggcaagtgatcaattactgtgtaccttcactaacttcagaaactctcctaatattccctaattccatctaacagtatttttttttcctccaaaccacacaaagcacccgtagcccttgactaggaaattaaaatttattttcaatttcctcaggcaaggcaaaagcaagtgtaaattaacagtctgtagcttgtctgggactagaaaagcattgaaaatgtagtgaggagtcacaatgtaggaaaattgtccaaagacaatgcaatatttagctgatggtaatctcagacgatatactggcaggacagcggcagttggacgaatgggcaatatctctagaagcaaaggaaaagaggagaggggaggcagttattgcaatgatttagaccaagaaaaaagccatggtttatctgtctgtaccaatctaatatactagatgacacaatatctgtccgtttcactgggtccaaaatagtcaactcactgtcacatgtaatttactcattgtaaagtaatagttttgtctgtctttatttctcacctgaataccttctgttcccagccctttctttttaataacatcatttttttcttaccataacaattcttgcgtatatctattctacacatttttattgaatttctaccatgagcaggcactatgtgaggcacaaaagaaagaatggtcaataaaaaccggtcagggattggccgggcgcggtggctcacgcctgtaatcccagcactttgggaggccgaggagggtggatcacaaggtcaggagtacgagaccagcctggccaagatggtgaaaccctgtatctactaaaaatacagaaattagctgggcatggtagcaggcgcctgtaatcccagctgctcaggaggctgaggcaagagaatagcttgaacctgggaggcagaggttgcagtgagtcgagatcgtgccactgaactctagcctgggtgacagagcaagactccatctcgaaaacaaataaacaaacaaacaaacaaacaatggtcagggacacaggtaaattaaagagaaaactacaattcagtgctatgatgcgaggatgtagtaggggctctcaaagcactaaggagggggcctaacccaggctggggaaggctttttggaggaggcaatagataagctagttttgaagataaaatggcttagatggtagaggaaacatcctatagcacctttgatccctcttagataaaagagctgttaacatatatgtgtgttttccttcagtattttaaacacacacacacacaccacttgatgaagaatcaaacacgggattttagggcacacacacacagagagaaagactggatttatagatatcataataattatctagatgtacatagatgtatagaactgtgatctctataggattcaatgttgttttttccatgtctttaaatatgtgttgaaaacatggattttgatagattaatattatatttaatagatgtttcgtaatatatttgatcattctctgtgtctgtcagagtttttgtttgtaagccacagaaaacaacactggctatattaagcaaaagatgaatttactggaatcatattaggtagctataggatctatgggaggcatggaaaaataggctaacaaaagggacagcaatcaaaataggctcagcagtgggacccctagccagcgctgaccacagaaacaatctgtccctggaatttttgttttctatacttaggtttcaatgttctgaataggggcatcttgctgaccaagcctaggtgatgtgtcccactttacctacaaggggacaggcagtaggaaggattgattttgtagtgagaagtaaggccccaactcccattaagagtccccatggggtccatctctcaaacaggaaaggcattaggacatgactagcaggaaaccaccaagaacatcttactacctccccatcgttagatgtttgggttgtttcttttttcccctattctattgtattataaaactgtgaaacattttttctctgcaaaattattgagtacctctctgattatctctaagataaattctctagcaatggaatttctggatgaaagggtatgaatgttttctcatctcttaatagatactgccaaattgcttctctggaaagtagcatccgtttaagctcactcttggagtgggtatgaggtgtgcctggtttcttacccagctttggcatgattatttttaggaatcatcacgcccacgcctttctaggctgtactcatttgtgcagcctgtacatcacttaaattatggttctctgaagttgaaacacctagtggcaaagtgaacaactgagtaaataagttgtttattttcttaattttatttgtgataattacttttattgattttcttcctcattaatttgattaatacaggggctgcttcttttactatgctgtagacaagctgtttctttttctcttctggaaagatagcatttacaaagcggcaagtgcatctgaaataatgaaaggttgagttctagaaatgaggttctaggaggtgctcaccctgccttggcaggtggctctcacggataatgtccagggtatctctcagacctcctgggaacaggcggagagctcatctccagaagcagatccattcagaagtcatagcagtgattcaactcctatggcccctaagttgggatgaacacgaaacccagagaggtgatgacgtatttcgtgacttttctattaacttagaggaacatctttctagcaagaaattgaaaggcatgaaaaatattagggtctgggcttccatcaagagagtcctaatgatgcccaagaaggaccacttgatgaagaatcaaacacaggggattttagggcagtgaaacatcatatggcaattgaagtatcatattataggtgatactataatggtagatacatgatgtcacacatttgtcaaaactcatagacccatgttgcacacagagtgaactctaatgtaaactatgaactgaataataatgtatcaatattgattccttaattataacaaatgcaccacactcatgcaagatgttaataatagggaaagctgtgctggggtaggggactgtatatgggaactctctgcactatctgctcaatttttcagaaaatggaaaactgttctaaaatataaagtctattaactaaaaaacatttcaaaaatacacacagagaaatacagtgtattcaggaagtagcacttgactaggagtctgggtcccggaatgctggtcctactcactagctgtgtggctttggagaagtcacttcacctctctggattttaccatagggttggaccacatgatctttaaagcgattctcccttctgatagcataagatctcaggattacttactttagatttgtcacccgtgtccagactgtgaatgtcggtagtaatcaaaacgtgcctttcactttgctgtctggcaagaaataatggaatgaataaaacacacatctttcccccttaccttggggctcagaagcctctctagagctagcaagacctatataaaagtcaggcataaagcaaataaggcaagctgattttttttttccagagaaagccacttttttttctctttgcataatttgattttagtgttctgcccttgttaagttctctcccacttgtagacatttacacaatgggttataatcatattattttattgttggtcattaaccatgggttaaccttttacatggacttatgtggtgtattaagtatgccattcacgaagactagagataaggcctgattttggatcatgggtatgaataaacatctctgggtgtctgtgcttggccggtagccagcttgatgctgagctctgattggttggatgctcttggggccatgcaaccgtgacctcaggtccaggcaatggtgcacattcatgggatggtgggctgaggtaacctcactggtcttgaaggaatgtcgatctcattagaaagtgtatatagcaaagaataattttcaattttccctaagtaaatatctggcaaagcctagaattggatcatgtccaattctgcagataaaatgcccccaaacacgtttcctctgaagaaaggctgaaaatatatggacatttatatttgtctaatttaagtaaatctcattaatgtgaataatgcagaataatgtacagtgatatagtggtttatattctcgtgctagtctagaagggagttcattatggtccaacaggaggttaggacttactgaggccttctctatatgaggtctttacacatgtaagctcttacatagtccaggaatagcaaatacacagcagcacttgtgcctcaactctccctcctgagctcaaagcagacattactaatgtaaaatgacattcttgcctgcaaagatggccagtagacctcgaacggggctttcaagaagacctaatgaaggcttgtaagaagaacctccctgcccaattaagtcaacaagcttatcttcatgggaagccacctttcctggagaagaaagatcttgcttcttggagacgactgtctttaaactcatggactaatgtaccaggttgttaaattgactttcattgtattcttagagacttaactgagtccccagaacagatgtcagtgattgctaagcgcccattctttctggaaaacatagatgctagacatatccttgggaagtttctgagagagagcaaaaatggtccctcatgtccatcattcacatccgtcccatgtaagagaaagaagaccagacattttaaaagatagaatgaaatgaaggtatgtcttgggagagagtaattctccccaaccaccactactacttccaggcaaataaaatagctgcaagagtaaatggtggaggtatttgggatgcattcctctgcctagaagactctgaaagctggaggctggctggaaatgacagtgatggtggagctaggagacagggtggaagtaggagcaacagcacttatatcatttgtagggcaagatgaatgggtttacccatgggctgagtagacacagaggagggcagtcaggctcagcctctctgaaagcgctccaccccagagggctgcctgtctgtttcttttatgcaaatgtcagttcaaatgttacatcctcagagatgcctcccctgaccaccagggcaatatagtgttccttgcagtcacactttattacaccacctggtttatttccttgacaccacttacaatataaacttacattttcctttgttagtttatttattgtctggtacctgtccaaagttttgcaggaagaattagaggtggagaagtgaggaaggaatctcaaagaggtcattctttacaaagtaaaatcatcttattaaatttaagttccatgagagcaggactttattcatcttattcaccgctattccagatacttggaacagaacctggcacatagtagctactcaacaaaaatgtataaactaagtacatctctgccaagcaagagccctaagagataaatagacatcagctggttctgagaatggcattttttccagtccatggcctgcttgtaaatgtctatgttaaaagggtgtagagggagaagcaagtaggaactataaactggaataatttttttgtcctctctgggtttctattatgcctatgcttcagtgtctggataaccagtaagtaacactttagggaagttttttccttctcctttcctcctagcctctgcttataatctgcaaagtctgctggcccctggaaactcacgtgggcacttagttggttttgactgattggattggcagtgatgagctctccccagccttgatatgcctccaggcttcagggaaagttgagactctggccagatgtttggagacaatttgggaaggtggaaatatacaaaggatatgcatttgctagtgttattcatggcttttgtgcacatcctcctgagtcatgttaaattaaaattgtttactttgagcaagtgtatgtcttcagtgattgggacccccgaaaaacaaatttattgaaaaaacatgggtaaaccagggtattttaaaagccattcatttctcatgcttttgattagagccacaaattaaatctccataaacctagtcatacagtgaagtgagaaattacagcctttcctttctgtaagaatttttttgaaagattgaaataaaaatcaaaatacatttgaatagcactttgcagtttaccggcgcttctacctatattatatcatgtggttgaaaaaagatatatcatttagtaaactttaaactgataaagtcataaagctgaagaaacttctgggtgttcagtgagtaaatgaatgtttgagtgcaatgtggagacagaatcatcattgcacgtcttatttataattaggattgttcatcaggttgaccttgaatcatggatcccataacagaaagttagatacggctgctttgagaactaaaaggcccaaaaagtgcagtcagatccatgttaagatttgtggagcccagagtaagactaatagagaggcctatttacatacgtatgaatattttaaatgtgtaaataaagctagaaaactgttaaattaaaatacagtcgatccttctaccttgacaagtagaacttcatgactttctggaaggccagatctgaactgcgaattcttggatgcctcgggtggatgtttctgatggaacatggaagggtcagacgagtctcacttgggtgccacctccttccctttccactcccagctccatcttataccacaggggccttgagtgcaggcaagtggatatcccaactccatatccagtctccatccacacctcatcagaaaggtgggccctggggaagaggtctgcctggtcctcagaagtgaactcagggccataaagtcaggcaattccagggtgctgggtacttagtatgaacaagatgggtgcaggctctgggtggacatgtttccttgggccctgggagtgctcactccatgaggagaggtatagtcagcggaggaacaaacagccctctctaaagtgcaggaacctgggcagggccccttgtgcctggatctaaaggtagtactaaatttaatgatagttagtgctatggtctgaatgtttgtgtgcctcccaagttcatgcattaaaattctaacccccaagatgatgatattaggaggtgaggctttgagaggtgattaggtgatgggattagtgccccctataaaagaagcctgagaaggaccttcacccctttctccagattaggttacaataagaagaccactgtctatgaacaagggaaatgggcccttattatatgccaaatctgccagtgcctcgatcttggacttcccagcctccagaattatgagaaataaatttatgtttttcacaagtcacctagtttcaggagttgttgttgcagcagctcaaatagacaaagatagttgaaattaaactgagcgttgtttgcttctcaacttttgtcttaggtactcttttctttaagtaaaccatttgtaaatgctatagtacctaaagctaccctaaccaaagacctattttaaatgatgctcaatttagttttaaaaaacatattgaaaaggggccacttgggatgaagaatccagtagttaggacaaatgaaccaaaatttgaaatagaaaacagataaagcattccatctcaagtatagacaggtgaactaaaagagctataattacaataatagtgcctttcaaagtataacttcttgtttccaaaacactttcacttgtatatgtatcattgagttcttatgaaattaagcatcaattctttgaagtttgaaatatatatatatatatatatatatactccagacaaatataaaaaggaacacttgacactgtgaagagtaaatttatagactccattagccaaggaatggtggaaatgagaggtggaacaatgtagaaagagaaatcaaaggcagcaaacaggcttcagcctgggtcagctctgatctttggatagtggccactgaagtgctagactgagaaaatcttaggtcatgcctagcctcagtggttagtaataaattagccatgcctgttacaatcaaagaaggggccatgatggcatgtgagctgtgaatgtgccatttctgggctggacaaatgcatgtggctgacagtaagggcaagcaggatgcttggggttatccttagtcttttgaggttgttggcaaggagaacaatcaatgcaaattctcagaaagaattctcatgttcttgaatatttctgtctttctccagcaaaaacaatttgggtttctttgaaaaagacgttgctttcaacttactttctgatatggaaaaaagatgagatagacacctgttaaggtgttgattggtgataactggatgcatagaagacttggattcttttctcaactctgtcactaactagctgtgtgaccttgagcaaatcccttaacccctccagacctctatttccttgtctccaaaatagggatattatctgagtgatctctcagagatttgtgaggcttaaaggagttagtaacaaggcaatcacttgaaatataaaacattacaccattgtaagccattatgattccactgaaaaattagcacattagtctagggtagcatttcccaaagtgtgtttttggaacatcagttctatgggatgtcaaccggtattacgctaaagctatcaaacaaacaaacaaacaaaaaagtgttttctggccaaataaatttagaaaactcaaggctaagcaagcttacatagttattttaccacataaattattagtcttaataatttaatgtgcactgtgaatcattaaaatgaggaaattatatgcagtaattcagacacttctttggacacaagactcttattttctcaacatattagtccttcagaacacagtcttttggaaattattaaaccatctactcttcaagttctcttctgacttgaatgccctctgattcattcatctgtttaacaaatatttatagagtccctattatatgccaggcactgttcagtgtaaaaaaaatacatcagtgtacaacacagagaaacaaatccttgctttcatggagcttacattctagcaggatttgatgtcactcactcaaagtgtactcatactttgagaagtgactgctatcccttaactcaaagatacaaagttgtaaagtaggatcattaaaaacaaagaaaggccagtggggaaggatagtttgtggggaaaggagggaagactgtgtgtcactctgcctccctatccctcagcctctgagttgaggttaaactatgaactcagatctgaagaagcagatggcttctacatcaggggcgcacaatcccatttgtttatttgtttatttactcattaatgtcactattcagcacatacttataggcatgacatatgtcatacacaacaatgcataagaccaaatttgtacccccagagctgactcccaggtgggcaggcagatcaggacatgagaaattgtgcctgtgtgttttatgtgctatgggggagaggacagagtaatgtgggggcacattgcaggggcactgaaccctagacatcagagaagacatcttaaagtgacatttaatttgaattatccagagagcaataggagtttgtttagcaaactggcttagggtgaattggggaaacagtgagtaggaaaagcgctctagtcagcggacacaatatgtaactaacaaaactcccatgacaagtttacacagtggaactggcatggaagacatatgtatatattagagttctgtgtatgattttctttgaaaaagggttctgttattgaaataaaacttgaaaaccattagtggtttcccaaaggaaatttttgaggctactctatgtttataattcttaaattctactgcttatgtaagtctttctgtcaaaagtatttgcattttcatggggagtttaggaagactgagatttctttcaaatctgaggtacacattgctgctggcagatagtattcattgaaatgatttttgttataaatgacagaaacctcaattcaagatgactttagcaaaataggaaattaattatcttacatgacaaaacaattcaaatggagagagacttcaaatccagtctctctccatttcagttgtctggccttcattctcagtcttagcattgcagcaagagggctgccaatgtctccatgtctgcatctttcatgtccaagtctagtggaaaagagggttgtcttcctgaagctgcgacataaatccctgtattcactctgattgtaccatcttatctcatgtgctcatccccaaaccaatcactgtagccaagagggtgaaactacaaagattggataggcctggatcacataatccaatcctggagcaggaagtgtagtcccatccaaaccacatgactgagaatgatttcctaaaaagtcctgaggctataagcagaagaatagggagggaggcagaaggggaaggagagagagatggagatagggagagagagagaaagagagtcaaggatgaagggaaaaaagagaaagaagcatcacggaaaacagtgatggattaaaaaagggagaaagcaaaaaagaaaagaaaaagaatgaaactggaagtaatacagtctagtgagttcttccttaaagcatcaccttgagggtaatgtttactttctccagtgatactgctttggctcaaaaggattttcaaactcctcttgaaatttttttcagagcctgaagcacgttctttgaatatgctcattggtggcgaatcctcattctttgggggtggttttgatttttgaaagaagccaaaagtcactgagagctgagtgttgaccaacatggtggctgctgcatctgcctcatctttcttgtgtccaaagtaaagtgcaatgatgtgttcataagtctgagatccttgtaggttccttttaattaattcattcatttattgttttattttaatttcattaacttaataaccaacactttcacatgtttcacattttcaaaggcacaaaagaatatatagtaaaaagtcctttcccttcccttgccgcccagccacctggtttaccttccatgttttgcgtgtatccttccagaaagagcctactcctatcccttaattgacttgaagaaggcccagagaggtatctctaagtaactgaagaactgcttgaatgctggctgaagagcactgcagtgtgtgtaagctgtgataggtttatgccaaatgcaggtgtcaatactttatccttaggaccctgagaagtctctgtaatatgaggcagtttcctggctcagatacctgagctgtgcgagatcaggtgggtaactttttctcttgagctttggttttctcatctgtaaaatggcgataatgtcaacaacctccttcgcagggtattatgcggtttaagtgcaatgatgtacgaaaatgtcctaaggaggtttattgtatgtgtcgacttagctcaaccacagtacccagtggtttagtcaaatactagtctagatgtctctgtgaaggtattttgtagatgtgattaacatctgcaatcatttaactttaagtaaagcagattaccctccgtattgtaggtgaaccccatccaatcagttgaaagcttagaacaaaacctgaagttttctagagaagaaattcagcattaagactgtagcctagaaatcctgcccaagtttccaacctgctggcctgtcctatggatttcagactcaacactgcaacatcaactcttacttgaatttccagcttcctggcctgccctacaggtttgggacttaccagctgccacatttgtgtcagccagtttctgaaaataaatctctctctctatatatatatattctattttattctattgattgttttctctggagaactctgactgatacagagggagaaaactgcattgcaatgaggcggggtgttgaaataaacctaggttttagtcctaggtctctttctgactggctaagcagctaagcagccctgggaaagacccttgatactaccgagcttctagtgtcatcacctgcctaatgcctctcaacattgctgggaagatggacatcatgaaaatgactcgtcaagcatcatatacgtgtaggttataattattcgagtcggtcctcctttgattgcacacatatccttaaaagtcgtgctttggtggctcccagacctataacttcttcagagatgtttccttcccagcattgattcttggctctgtctctatgaagttcatagtcagggaatgaaatccagtccagcctcaagtagttgtcaagggggctagagggctccacccaaggcctcagtgggctctgcacccacaggcaaggggaagcagagggaggagggtaggggaaagtggagggaggaacttatggaggcgggagtaggagggggaagggaacgagaatgagagaggaaggaggacatgtgttaagatgggtccccaggggtccagggctgatttgctggggttgctgggtctgctctgcagattgcaggctgattgcagcagattagctgggacctaaaaggggccttgtcacagcccatgaatccagtgctgaatattctgatatttctcttatcttggggttagagccaatcaaaacagagaggaccgggggatggcagggagaagcactatgaataacctgcctcctttgccatcacaatgcgtcaaaacaccactcagtcccatttccacttgttttctcctttgccagggattcaagaactggcacttgagagggatgaaactttctgtggtgtctaagaggctcatgttgctttccaccccaccttggtgttctttatttcatcactcaaatcttttctttcataccacttatcataagctgaacttatttgataaaaaattatttaccaaaaactgctctctcaaccagaaagtgccaccttatcttatttgcctgcccctgtagtgccagttcccaacagagtggtgtatggtaatgcccctaaaaatgtttattaaggaatgggatggatgaataccatttactaatgggatggatggatgaataccatttactaagggccctctttgtgccaggcaaggagcccagagctgtacaggcatttgtcatctgcttttaatgatagttctgtgaagaaggtatgataatctttattttactgataagaaaactaaagtccagaaaggtcaagtaacaaggccatggtcacacagtcagacctgggattctaatctaggtttgactgactccaaagtacatggtcttaattactataccatggataaaatatgcgttttctgccatgccagcattgattggcaattgctgccaggagcccttaactgagaagaatatcgaggcaatgtccaacttggtggagaagagtgcagagatcaattagtaatgtctgcaaggggtgaagtagaatgtctagcggcacatgtaccatctgtttttcattttaacacatattatatcacctccctaaagatgtgcactagaggcaaagaaaaaaaaaagagagagcgaaactaggaggcagaaatgcttaacttcttttctggccctagttttcaccccttcttgttgaacttttctttaaaatgagaacacatctatctacatgcttatttggaggacagaatgcaatcagaagtaggaaaaagctttgaaaagtcttggaagcaaaggttgtaatattgcttcttaagctgactttatgatgcttcaggggctttgggtcacctgatatttctgtaggactccaacactcctggcaaagatgctgttattatttcccaaaagcctttcaaagaaatcaggggcagggaatgaggggaggtgacagtcaggctgcagagctggacattgggaattggagcctattgcacttaagactttgtaatctgttggccatggaataatcatcatgcatttaccctgccagactaaagcctgggagtaggacagtagattggttaagagtggggcctgtagagtttaagtcccaatattactgcttactgtgtaatcttggacaagttatttaatctctttgagccttgatttcttatgtaaaatagcatctatccaagggcctgatatgagaattaaatgagacagtttgaggccaggcgcggtggctcatgcttgtaatctcagcactttgggaggctgaggcgggcgggtcacttgaggccaggagtttgagagcagcctggccaacatggtgaaaccccgtctctactaaaaatacaaaaattacctggaggtggtagcgcacgtacctgtaattccagctacttgggaggctgaggtacgagaatcacttgaacccgggaggtggaggtttgcagtaagctgagattgcgccactgcactccagcttgggtgactgagactctgtctcaaaaaaaaaaaaaaattaaaataaaataaataaaaacataagacagtttgtagaagaaaacaatatggccctggcatacaacaagcacaaaatgcatgttaattactgtctatgaggaatctgtatgcacacgtggaaaatggaaaatcagagcaatgatctgaatctgtgttgttccaagccagataactggtggtattttggtttttgtttgttttcctacttttttgtttgcatctggatgttctgaatacccaaacttggtgtttttctcagaaaggagacaggcaagcttgttctaaactgttcatctccttcaagtatccagtctatatagttcttgctgctgttaggcctctctctaattgaacaaggggaaaaatcaccctctcactgcgtgttgaaaaactggattttaagaatataaagttgggcattgccccacttgcccttcatgaaacacactggcccagaacagactttcttctcttcatcttctgtaagaaagagcttaggccatggttatgtatggtgatagctaccatttactatgaggcactaattgtgtgccaggaacttcattctcctgatagccctataaggtggccactgttgccactcttggtttgcagataatgagattacagccaagtatgtttagctcacctgtcctaagtcacacagtgagaaagtagcaaagctgggattcaaacccaggtcagtcaggcctcagtatccctgtgctaaccacttagtcatattacctaatgggaattctggcttagtgaataatctgtttggcagaagggatgaaatgtcagattcataaaaaatgataaaggggatatcaccactgatcccacagaaatacaaactaccatcagagaatactacaaacacctctacgcaaataaactagaaaatctagaagaaataggtaaattcctcgacacatacaccctcccaacactaaactaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttagccaccatgatcaagtgggcttcatccctgggacgcaaggctggttcaatatacacaaatcaataaatgtaatccagcatataaacagaaccaaagacaaaaaccacatgattatctcaatacatgcagaaaaggcctttgacaaaattcaacaacccctcatgctaaaaactcttaataaattaggtattgatgggacgtatctcaaaataataagagctatctatgacaaacccacagccaatatcatactgaatgggcaaaaactggaagcattccctttgaaaactgtcacaagacagggatgccctctttcaccactcctattcaacatagtgttggaagttctggccagggcaattaggcaggagaaggaaataaagggtattcaattaggaaaagaggaagtcaaattgtccctgtttgcagatggcatgattgtatatctagaaaaccccattgtctcagcccaaaatctccttaaggtgataagcaacttcagcaaagtcccaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatatattcaatgccatccccatcaagctaccaatgactttcctcacagaattggaaaaaactactttaaagttcatatggaaccaaaaaagagcccacatcgccaagtcaatcctaagccaaaagaacaaagctggaggcatcacgctatctgacttcaaactatactacaaggctacagtaaccaaaacagcaaggtactggtacgaaaacagagatctagatcaatggaacagaacagagccctcagaaataacaccacatatctgcaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctacacagcaaaagaaactaccatcagactgaacaggcaacccacaaaatgggagaaaattttcgcaacctactcatctgacaaagggctaatatccagaatctacaatgaactcaaacaaatttacaagaaaaaaaaacaaccccatcaaaaagtgggcgagggacatgaacagacacttctcaaaagaagacatttatgcaaccaaaaaacacatgaaaaaatgctcaccatcactggccatcagagaaacgcaaatcaaaaccacaatgagataccatcttacaccagttagaatggcgatcattaaaaagtcaggaaagaacaggtgctggagaggatgtggagaaataggaacacttttacactgttggtgggactgtaaactagttcaacccttgtggaagtcagtgtggtgattcctcagggatctataactagaaataccatttgatccaaccatcccattactgggtatatacccaaaggactataaatcatgctgctataaagacacatgcacgtgtatgtttattgcggcactattcacgatagcaaagacttggaaccaacccaaacgtccaacaatgatagactggattaagaaaatgtggcacatatacaccatggaatactatgcagccataaaaaacgatgagttcatgtcctttgtagggacatggatgaaactggaaatcatcattctcagtaaactatcgcaagaacaaaaaaccaaacactgcatattctcactcataggtgggaattgaacaatgagaacacatggacacaggaaggggaacatcacactctgcggacagttgtggggtgggggaaggggggaaggatagctttaggagatatacctaatgctaaatgacgagttaatgggtgcagcacaccagcatggcacatgtatacatatgtaactaacctgcacattgtgcacatgtaccctaaaacttaaagtataataataataaaattaaaaaaaaaaaagaaatgtcagattcataaacgaggggctgtgagaaatggtggaggggtcgcagccatggttctcatgcccagctgctcagctgaatcccctgaggagcattcatgaaatagagattcctggtacccacccgcaaaactgttgatgcacttgatctaagatggagccagagctttccaggtgattctgatgggcttctaggcttgagaaccactggggcagaggaagaaggtttggggagagatttagcaaattccttgtggttaggaacttttccattccctcgtaggaagtggctaattcacattccaggtggtgtacctttatctcagtatctccgtttgcaggatgggggcagtggagcttgacaacattgcaggctgctgtgtggataaacagctcgtaatgtgccatttaaatgggaagcattgggatgaagtgttcctggggcttgaagtgaccccattttattttcagtgtggaggtgcccaggccacatcttaagcaactttgaaccatctggaaccactggacagcaaatggttaatcctgtaaggccagggtgtgagggatccggtcatgcagctgggggtaactggggaactctcattgtcccaccctttggttgaggaacagtgtgagccgacacataattagaaccactaactggctttcaatatggagaatgagatttgtggctcctgctcactaaggaaatatgaaacggtaaacacacttccagttatggatggggctaaacacaccattaaactgaatgctaatagctgcctccttctcccttcgaacatttcaccgtggcaaccagtaggtgcccttttcttgccttctctttcagcttcccataattctcttctgccgtggttctttggatgataatgggcacatgcttgaaatagtagttagagaataagaatttaataacaacaagaacaaaaaagcaaatgaggctggagtaggtttccagctcctcatattatttgcttgtaggctgtagcaatctcaggtattgagaataaaccaaaatagactgagatgaacatctttaattgaatgtgagtgtcttaaatatactgcatgctaaaggcattaagcttgacttctgaagctcagtcactaagttgtgggagcaccattactcagggtttaacaacaggaggccaggagtttgacatacttgagtataaatccttccctattgcctaatggctgtgtggccttggatgaataaccttctctctctgtacctaagcttttccatctataaatcatggctaataataataaacttttcctcacagagctattgctggggtggagtggttaaagacacatgggtataaagctttcagtatagtgtctggcacaaagattctcaataatcaatagctattctgatgatgatgatatgattaacaacttgctgggcaacgttaggcctgtaacttccctgagcttcaaatttttcatctgcaaaaggcaagctaatcacagtacttgagtcatttgcttaaggctctagataagaattaaatgatgaaaaggacttggtacaggtcttggcatataataagagctcaaggaggacttgctgaatgaatgggaaaaaaataaatgaatgctatgtcggctggagaaactcagtcatcagacccaaagtgtttaatatgagacacagaggaagaaaaatacaaacagccctggactctttgtcagttacattttttagcagccgaagaccttccgttgcttcctttctccttgttgcgtccgttcctcccgccccttatcaagactgtctgctggaaaagagaaagcataatgctgacacacacaaatgaaaccccagtatcacaaggggctcctagcaaggcctcagacaggaagggccataaataaccgagtggcctgtgcaacaggctcagcctgtaaagctggtcagtaggacctcttcagtccctgccctggcccctcaagtggccagtgtcctcaccttgagccccacacctccttccccatctagtgcccctcctaggtctgttccccagggcagtgactcatactctgaattgcttctccctcctctgccaaactccagctttccctgggagaaaactatctggtaagccagtcactaaaatcattgcttagtcagccactctcgtgggggtaattgaaatgtcttttaaacagcatttatggttttaatttctaattataaaagtgatacatatttattttagaaaactttggggaaaaaatctagggaaagtatccaagcatgtggaagaaaatacgaatcctgaggcccaggtcacagcccaggccaatttgatcagaatttctagggatggtatcctagagcaggattgttttattaagttccccaggtgattccattgcagaaaaggttctttacttagagatacctgccaataatactttgaagtattctctttaccttttatattgatattcagattatactgtgtatgttattcaaaacgcgaatttttttgcccagtgatatattatgaacatcttcccatatcatcaaatattctttgaaaacatgatttttaaaacgggcatgtaatgttccatcttatggatccacataattagtttagctaacaatccattattagacatgtttctaaatgttgtcaattaaaataatactgagatgtatttctacttctctctctgatcacttacttagctcacacatagcatgtaatcgtatgctggacatcattctaaggcattccatatatttcatttaatcctcacaaccagcctatgatattatccccattttagagatgaggaaactgaggttcagagagcctaaatcacatggctggtaaatggtggagcccattcatgctctggaattaaaattgtggggttcaaaaaaaaatgaacatttttaaggcttttgaggcacactgccaaataacctaccaggaaggttgtaatgattcacttcttcaccagcagcatggggaagacagtgcaagggtctctgaatttgaaaataattctataaaccaatggaatccctccatttaaaaaccctccttattgcaggtctactatgtatggaaagagttttttggagtagggttttaaaaaatgatatctaatagctgcatagcatggctttacagtttgtaagtgatgttccaagcataagacagcatattgcttttgtggagggagggaagggggactgcccagaatccttcagcttgtgccacccagtggcctgccctgtgggagagttctaagactgttcctgagcactggtccctctctaattgtcttttcttcccacccttcttttggggaaaatgcttctggtaagacagagaaaagagacaaacatttccaaatgcagtagttaatggaagaggtgctgtgagaggagagatggcattgttagagcaaaatttgctgagcttttgatgttttaccaaagagcccaaagcccccttccatgaaggaatctgactcaactctcttcagctcccaatgggagtgaatggagctgcttttctgggagccctggagggagggcaggggagcccaaagggccaactggacaagggaatcccaagaaaggaaggaaaagctaggcaagagagaaaagatgtctggaagcccaatgagaggctcgaggtgggctgatgtgtctcaatgagaaacatacaaagctctgcgcaccaccctttggctcctgtgtgtatctgtcaagtgtgataattagcttggtcattattatttatcttttggaagaggattgtgcctcccctgccattccctctcccaccacacatacctacactgacatcatcaacctttctgaaggatttcctatttgtagcaggaaagcaaaaaacttcccatgactatgagtttcttgaggacagagctccatgcctttttaaaaaaattatattcattctcagcggctccagcaggtcaaaattttaatttccattcacagggcaacctattgaggtttgattgaggcttcaatgggagttatgttagtgaactctattttggctgccagctagagaaactcacttcaaacttccttaaatataaaaaagagtactatacacccataaaaaagaatgagatcccatcatttccaacgacagggatggaactgtaggtcattatgttaagtgaaacaagccagatacagaaagacaaaaagcacatgttctcacttatctgtggcagctagaaatgaaaacaactggactctttgattatggcccaataaaggagaaagtccaggatggggagcagatttggctagattcagagttttgaaggttgttgtttgtttttctctctctctccatctttctttggactggcctcattttttcctacttatgaatgggcttccttcacatgtccagagatcctttcttcggattttacgtatgggtgctgagagagagaaatcccctttgcccaggtcattgctaatctgtgttgctcatgcgtggggggctgcttaagcctttctcttgcgtgaccccagcttcacaatctaatggagagagaagactgctcttccaatgcccatacaccaatctcagagagacagactggctggcttagtttgagtcacattaggtcaactgactactgtttccagtggcatgaagtatcacaagtggccagaccatttacaggacaacccatgtggtcaggaatggcatctgttgcccaaagaaaagggtgaacaaacagtgtgtcaggaaagatacaactccccgagaaccctgtagtggttcagactcatgttttcccagtccagagtctcagctggtccagttaatttggatttttatttctgtctctaatagcatgtctttcttgcacttttctatctgcaaaataagataagcactcatttttattaaagtctgattttttaacctttcctcttgattcattgcttccctgtaattttaaaacatgcagatatcattatatttactgctattcttgaatgagtaggtctactttagaagcctcgatttctcaaccagttgcttgctgtaaactgctttaaatatcaggtctggacacactcctctgttgaagcagcctcttgagggccactaatgacccctgggtgctgaacccattgtcctttcttggctgcattgtcctggctgctgcagcagttcgtgatgggcaatcttactttccggcaccatctccattttgggagtaaaaatgtcctcataaaggacccagaaaaactattttccttcttggcacttctgcccttttgggctgtctggttttgttctctgtctataaatagaggagggactcattgttcacccctccacctttcagcagggctgcaattttgcctttggaacgcagaccgaacttgtagaaagagcatgagctttggaatcaggcgaacttggaatcacatcccagccccacacttactagtcataggattatcagtgaggcctttttgttttgtttttttgttttttttttgaacacttctctgagcatgagttcctgctcctgtaaatggagggaaacaatagtgtctgtctcataggatagcaacagagtttcataacaaggtactgcacccagtaaatgttcaatgcatgtgagttctcttcctccctcaaagatacttggtttgtcctctgtcactgtattagttctgtgctgactcactccttctgtatatcttatgagaattgccactcattaaattgtttaaagtatatcaatgtcttctgtattctaataaagctggccattagcaacaatcctaaaactactctttggtaaagtccttttctaccttttcttttggaaaacaagtttttccttttattccttctggtgtaacagacgtctctctctgcctcctcctctccatcctattcagcatctactccctttctatggaaaggcaccctccttgctgtggggaactgttcgtttgcaccatgtggttctggtgggtgagctgtgtcatgtgaccaaggtttgaccaatcatgggatctcacgcatcttgcgacagtgattggcttcatgatggccacatgacctaagtttggtttattggtgttcttcccttgaattttacctctgagtgctaggagagagaaatctttgtttccttgggagttgcaaatctaggttgatgaagcctggagctgcccatgccacgtctcctgcagtgtgaataaagctctgctatgtgaggaaagaatgagtccaacagatggagagaagcagagatctgagatatggaatgagatggggtgggagaggaaggagagagggagagacgatatcattatttgaattcctgaggacagctctagtcctagcctttgtggatatgagccagtaaattctaatttttctttatgccagattgggttaggtttctgttccttgaattcgagggtcctgataaattcatcagtttatttaaagtaactgttacattataaatgagagttgtgtatatgttgcaacaaaatcccaacagttagtttaagttgctaataaggaatggattcctatactgaactccttctaagagcacagaggtctggggttacagagccccttctatgtttgtatcactggaacctagcatagagcttggcacatggaagttctcaatatgtatttggagaacacagtaaggcacgagagagaatctgattggctcaatgggtcagtaccatccagcacaggagagtcctactggctggaccacggttcccacatgggccaacatcttggctacctatgggttaggaacctcacccacggtctggccagctgtgagtagagaataataacttctggtgtagaaaatcacctctttttctcatggtgtagaaaataaccccttttgttaaatatttatttaaatttgactatgggtatggcaggtactctgagtctcacaaagggaacagaatagcagacaagtgcttcacttggcttgttcaggccgtgtgagtcctcccattaaatccctcagtgaggggtctgaagagcgaccggggaagttccagaaaatgctggtctgcttcctgccgagggtctgcccttgagcttctcttccagaggagaaccgtgactctgaccaagggggcagttctgggaaactgtgggagcctgcagcaaatgacagaaaaggggctgactccagagtgaccctgccaggccttctggtgagaaacacgccccttgctatggtgaggccggccacagcctgacactgcctctgctggggatgagagcatggggaagcaacagcattccagtgtcagcctggctctggctgtgccccaggccctgttcccactgtaagctgacactggctgggaggggcctctcatctcctctttgagggctccagggcagagtctgttctcagatttgagcagcagcctgtggatgctgcagagagtgtgaagaaagcaaaccaacctctgtgggcccagtgagtcgggtagggccctctgatttgtgtctgagaggttggcgtttgcagtagattttagtcttgaccttgtcgacttggcaacagggttaaatgggagacagtgaactgtatctggagggtctggattggggcctgaaggcctaggggttagcccagttctctctgtaagctgttttggggccaggggccagcctttggtacctgggcctcaggctcctcagtggtaaattgaggaggtttgtcgggccatgtgcacttggaggttccttccaacctgagtaatccccactcaccatcaagtaatggctctaaattcatttgctctgtggagataaccaatatggaaaagattggcctcaaatttaacttttttttataggcagtaaaggatagatgagaagtaacattattccaaatagaatgacaggaataataattattacagtaataacaataacaaaacaatgctttcaaaatagtcactgtaggccaggtactctaatcaagattttacataccttaccttatttattcctttccaacactcccctgggtggatatcatggtacttgtttaggagacgaaactattgaggtgcagagaggctcagttacttgcccaacagctcattgttcaaaggtagcagtgctgggatttgaacccagggtccact

SEQ ID NO: 19 - DNA, 52153 bp, Homo sapiens
aggtctaattcatatcccgcttctgacaccatctagtaaaagaaaaacttcagccaatttaaaggagtttaattgagcaatgaacaatttgggaatttggcagcagaatcacagcagattcagagaaactctagggatgccttgtggtcagaacaaatttatagacaaaaaaaaaaaaaaagagagaagtgacatacagaaattggcagtgatgtacagaaacagctggttggttacaggttggcatttgtcttatttgaacacagtttgaacatttagcagtctatgagtggttgaagtatggtccactgggattggccaagactcagttactgttacaggcacatactcctaagtcaggttttcactcttgtctgcctgttaagttaggttacagttcatccacagggattcaaatatagaggtatgaagtccttctcaggccatatttagtttgctttaacacttgaattccacccaaacaaatcagcttgaatcagtgtgaagggaagtgtgacaatttttaaatttgtcaattccttaccaattgttttagtgttttagcattcagccccaaagtcccttactcttggcccccttcagttttttccctcctgtgatggtattagtaaagatctatggttagttatttaaaatgagactttgagaaaagcaagacccttggatttctaaattttactgatgcattgagtatttctaagctgctcgatagattagagttgtttggtgtggcagttccccagtgtgtccagttgctcacaaattttgacttgaatgttctttgccgaattggcactgagtttctccttcttgccatcatttgcttcatgaaataatctttctttcgtttacatttataatcaagtgcagtagaaagattttaaatgagctattataaagtctactaatgatttcttatctacataggttttttgctcagaacttaatatttcaaaatttaaattacacattaataaacatattcctaatacccttgtaaggaaggcaaactaatacggaattttatttgaggctgttttaaaatatacttgattatgaagtcccttgaaatattttaatgttcaaattaataccccataaaaaaatcaatatttgtgttattatttaaacatgccctagtgtaaaagtttaagtaacactaagttcataactaagaatagcctaaaaactaattttcagttcataacaaggaattagggcaattctttgctcatttaattatttaaataagtactctttttaaaaagataaaacaagacataattccaatatatttattttacatttgaacagatacttttatttaatacaactattcattatctataaaagccttagttctgaaacagaagtgagcaacagaaagcaaaatattttatttatttatttatttattattattttttgagacagagtctcgctctatcatccatactggagtgcagtggtgcaatctcggctcactgcaacctccatctcctgggttcaagtgattctcatgcctcagcctcccaagtagctaggaatacaggcacacaccaccatttccaactaatttttatatttttggtggagacgggatttcaccatgttggccaggctgctcttgagctcttggcctcaagtgatctgcctgtctttgcctcccaaagtgttgggattacaggtgtgagccaacatgcccggcccaaaacattttaaatataataaaaccaaaagtgggtaaatatatatacatatatatatatatattctcactgtatcagtgtactgtataaaaactttactccaatagcctgaatttactaatttggtctaattttaaatacagaagagagtgtgaattagtaaacaaaacaacaacaaaaaaaatggaatcataaaacattgtataaagatgagtaaagaaataatatttaccctaaagtccaaggtcaaattgggctagcaaagttcactcagccattttggttgttatttagtacaggtcctttgagaaccaatttaaacaaataagtctgatccgttgctaacaggatccattgttaatatgtaaaaaggtgtctgagatcagtttagtctcttctaagttcttggtacaacctttctgcccaaaccaatttgtactgtcaatgcagagagtgtttttaaacacaatggcagtgctaatagatagcttgggggaaaaagtgggatgtttatgacttctaccttttctttccaaagccccaccccactgatccttaaaataagcacatggtctaggtagaaaccagttctcactatgccacacaactgcaagacatgttccccagcctccttctccatccgcatcaagaaagtttggagctgtcaccatcattacaaccctatttgaaataattacaaaatctagactcagaacagcctaaattttagggctttattatataacattctctttttaaatatgcggtagttacggtcaccttggaaagttctacaaaatatcccttaagttttttgaactttcccacatgggaatcttctggttatgagagtttgctctatttaatatgtgtacggtttcactgctagggtggttctcccacttatcttgaatctagtgtgagtgttttgaaatgtttctgctcattgaaaagaagcagagcaatagagatgagaggaaaatctgaaaagataatgacacaatttcccacttaattttcattaagtaagagatgaaaactttagcctcggcatcaggaagtttgatttctttaattaattttttttttgagtcagggtctcactctgttgcccagagtgagtgcagtggcatggtcacagctcactacagccttgacctcccaggctcaagcgatctttccacctcagcctcccaagtagctgggaccacaggcatgcaccaccacacccagctaattttttaatattctgtagagacagggtcttgctatgttgcccaggctggtctcgaactcctggactcaagcaatcctcccacctcagcctcccaaagtgctgggattacaggcatgagccactgtgcccgacctaggaaatttgatttttaatatacattttattctagttgacttcctaatctcctatatgattgcctgcttcttctaacgtgtcatttttgttttttaggattaaaagaaggatcttattgttaataccaaagtggctttatgaagatattcctaatatgaaaaacagcaatgttgtgaaaatgctacaggtaacctaacatcatccaacaaaaactgagtggcaattgagaccaagagtgcagtctaataattagaatagaatttccattcaaataaataaatgtgcacacatattaacataattatatagacatgtgtaaagacaaaactgtacctgtttcaaatcatacttaaaagagatgagacaatagagttgggggaaagaaaacagagaagaaataaagaaacaaacctgttcaaaagagaaaagtgaagtggaagattgtgggccttgtgcacgagtcacctggtgaccaaacaatggtagatgtcttcaggaacaaagggagtagggaagaaaagctcaatgaaatgagcctcaaagattcaaagggcttctgtttcacatgagatggagagccaggtggagcccaagaagggcatcattttactctttaaacccagtggaatttgagaaaagcaatgtgagagaactgtgaacaatagtgtcacaggggtgggctaggtttccattctggcaaagagaaggccacacaccaggaagcccctgagggtacagggacattactgattataaaggagggaaggaacaagctatgtgtgttcctgataacccctggccctcgggattggctgtcaaggggctcaaaacccagtccaagggacaaacacatcatccaagccttgcaatgcagtgatgtaagtgcaatgatagaaatgagcccaaacatgtgatgggagtggaaaggaaacactgaaaggagaggagctgctcaggagaagcagggagaattcaaagtcagggggacccctgggggttagaactgcatgttgggtaagaagatgaggtgtttgtaaaacaaatagaagtggctctgtttcaagctctggtaagcctattagctaactctttccccaacctcatgtcatctgaacaaagggtttctaggctaaaaataaaatactttttaaaagttcaaaaacaactggtcaacagaatagagtctgagttctgtaacacaagacttctgtgatctgatccactcaccattccagctttactccagccactcctcacgtcaagatttttgatgaagcaatacccaatgtgctgttcttacccaaacctggcaagctccctaaggaggctggggctgaagaaaattggaatgacacttcatgtctgtttattcaagatctccttctttgctaaactcctttcctattctgggctcctggaattagaggcaaaccttagggcttccctcagataaggttttgttttctgcccgagagactaaggaatgcttagtcggcttgggtggcttaaacaacaaacatttatttgtcacagtgctggaggctgggaagtccatgatcaaggagccagtcaattcacttgctagtgagggctgtcttgtggacagctgccttctcacatggcagaggaagagatcatctctttcctgtctcttcttcactaatcccattcatgaaggctccgccctcatgacctaattaccacccaaagtctccactttcaaataacatcacattggcttcaatgtgaggggggctggggagagggcacacaaacgtttagtccgtaacagggggctataatattataattgtgttgggtgacagtttgcccaggaaggccagccatctgttggaaggcctccagtccatttattgcccagaaaagtcatcaggctaaaaccttcacccaccctccttatcatcacaaacatgtctgaattgtgagtagctttatttatttatttgttgttttttgttttgagacagagtcttgctctgtcacccaggctagagtgcagtggcatgatctcagctcactgcaacctccgcctcccgggctcaagcaattctcctgtctcagcctcctgagtagctgggattacaggcttgcgctactacgcctggctgatttttgtatttttagtagagacagggtttcaccatgttggccaggctggtcttgaactcctgatctcaagtgatctgcctgccttggcctcaaagtgctgggattacaggccttatccacctttagaacctcggcatcaagcatttgtcacacactcattctcggtatgtgagcaaaataggattctccccaacctttttttatttaagcaacaaagtattttcttgtaacaagaaatattaatattaatattcttgcctcagaagaccaacttttaaaaggccctaaaattaagtaataagtaataagttaatatataagactcaacttttctctttaaaacttttaaaccaagaaatgtgcttaagaagtggattatttttactattccttttcttcagtcttctcatgcaaatttaataaagatttggaagcaagcaggataacaaaagacaaaaggaggaaatcatatgggaagataaacaatatgagaaaatggagggagaaaggaaagttgaaagaaagcaaaattcctatcctcattcaattatccagttggttcttttaaatgtcttttgcaaaataaaatgatgtctttttttcctaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctggaaaaaaaaaaaaaaaaaaaaaaaaagaataactaatacttgcttgcaaagggagaggcaagtttaattttcattttatcacttaaaattctcttgagtagataaaaatatagccccaaatgacaaaataagtgaagaatagaaacagaagagaagttagtcgtttgctgtattatttttttcccctactctccaggtattagggatttgatcttagtgtgatttgggactaacagcgctgtgaaacaataatgtgtggaatcatgggttgctgtcttcacttaagtcaagagtgatggccttgttttcctgtggcatagttgggatattatttatactataatagaacctatgagaggtaacagatgcaggatcagcaagacgtaattttttgtttacaaaccagatatatgttagaaaattattgttaaaacaggtatctgttcagtacctgttttgatggcaaatacttgctgaacctaccattgccccatatcccatgtctcctgcagatatcaccagccaatcagaacaggcctttctactgagctgtacaagtgccctcagaagcctcccaagcagtgttccttatggccacaatccataaggactggagtaggagattaaatctatctaccaatgatgtcaatatggaaaagtggttgatctttaaaaatgaaatacatattttaagctgagaaatgttacccagcagactattgtgattaatatttatgggcaaggacaacttttctgaatgatcagaacagtttaaaatagggtagagtagggcatgtaaattcatgcctatagtcctagctactcaggaggctgaggcggaaggaacacttgagcccaagagttagacactgcagtgcgctatgatcaatgatcatgtgccagagcaagaccccgtctctaaaaaataaataaatattcgttcattcattcattaaaataggtagattacacactgaatttctttttctcctccaacagttgtcaatttatactcatatttagtcatttaattttattatgaaaaatcaagcagttaattttaaaaagactcattgcttactatgtctttagcaaatgagcaggctattttgttttactttttttttttttgataaaaatctaaaagcaattttatggtcattaagtatccttgaaatgaggttgactgtatatcccagtttgccctggtttctgtccattgtcctattgttaattatgaccaataactgccctcattcactctcagaagcatcccttatttggataataaatcatatggtcactcaagactacttaatgtccagcatgtaagtaattcatcagaaatttatctttttttttttttttgcactgacaatcctctttattttactttttatcatttactaaggccattttgctccaaaagggtattactattcatactgtaaaaaaaagtatcccctgatacttttacatagtgtaaaaaaaaaaaaaagttatcccccagataaactctattctgtttatcctaaaatatgtatatattttttgtactttgcatattctgaaaggaatatattttaaatcactaatgaaatgctaatcttaaataccttgacttgtaaattgccgtatgcctttgcttgattcttttgcaaaaggagaatcataaagtagccaagaaggaggtagcatttgagattgaaataacaaaagactaagataaatctttgatgtttgcaaacctgatgaagacgtctggtaacatgtgaagaatatttttatagtacgtttcaccataattgtaatctatcacacatgaaaaaagcttttatcaagcttaaaggattacagcattgtttgatcttctgcaaatgtttccactgcagcgagtgcctccttttcgccccctagagtgggaaggaagctgctttctcattctgtggtgtcttaacccacatcactattcagcacaaaggagacacttctgattctgtctttgccattagcccttgttggtcccaatggactagaaattgaggctatacctgcaatgggagcaatgtacctgcctttgtcccaactcaggggaaaaattcaagctgctttatcacaatgcaaacttcgcgggggagaaagggtttctttctataattcttgtattcaagaaggattcattgaactactgaatgtccttactgttatatgtgcaaggccatttgaaggatatggatttaacaaaaccagtcaatccctgcaggcttggggcttatatcctagggggaagagacagacagtaaattaggacaagtcattgcccccaaggagcttacattttagtaggggaagaggccagaggtagggggtggagagaggcagaaaaaaataaaggaaaatgtcagataataagtgctgtctagagaggtaaaatgggataatgtggtggatagcaaatcggtggccactttacactgggtggtcaggaaagaccactcccaggaagtgatactgatgttcatctgagtctcaggtaagagccagcttgccactgacaaatccttctatagagaaagccttgagtggctaatgtctttacttctttccctcccgtacaacttgccactgattatcttccaccctgaccactccccacctcccatcttaaccttcttaagccagaattttctgcagattctgaggacaagtgcatacctattcatctttctatctagctcttgtgtctattattaactttctttctctgagtctcacaatcttttaagtcgctgattcctaaaggggcatgtcctgcttcttggtatgggtaaaggggaaggaagaagagagaaaaagcctctcaaggtatcaatcagagggaggaagggaagagaaatacaaagaaaggcaggttgatacttaggaatgctgaagcaaaatggagtgtcatagttctggacaacactaatgctgactaaggaatatcgtttcctcctgctctagtatctttctctccctctccctcccttttcttacataaaaaccaaggaggaggtgcaagtcaagtacagtttagggatgtttgcttggtacgtgtgcaggtgtgtacgtgtgtgtgcgtgtgtgtgtttaattggaatttctttccttttttttttttttttttttaacaggtcacccaggctggtgcacaatcacagctcaccacagcctcaacctcccaggcccaagcaattcccctatcccagcctcctgagtagcaagtgcacatcaccatacccagctatattttaaattttttgtagagacagagtctcatcattttgcccaggcctggactcaaactcctgggctcaagcaatccttccaccttggcctctcaaagtactgggaattataggcatgaaccactgcacccagactaaaattaggatttctttttagttataaatagtattgaagagaggcttatgagtttttaaggtgtggttttcaggtaatgtgggttgctgtttggccttccagtgtgttcccttgagtggctaattcttatatttagtcattctccctttgacatagagacagcacatgactatggcattgagcaaaagttttcaaaaattaattttagcaattgattctctttctccaaatgcaatctgttggctaggcacagtggctcacgcctgtaatttcaacactttgggaggctgaggtgggcagatcacttgaggtctggagtttgagaccagcctggccaacatgatgcaacccaatctcgactaaaaatacaaaacttatctgggcatggcggtgcctaacccaggaggtggaggttgcagtgagccaagattgtgccactgcactccagcctaggcaacagagcgagactccatcgcaaaaaaaaaaaaaagcaatctgttgtagaatccttaaatgtaaaacggatgaaagcaaatctcctgttgaaacagaccttggaggtcatacctgtgccctctgcttctccctctctcttctccgcccttgcctctgaagcaacatgaaaagctgaggctaggagctgtgctcttctatacttaggagactgggatgctggaccaaccttgagaagcctgtgctttagaactgaaccttactctgcactttagccacaggctatcaacgcaggctcaggggaccaaaaccaaaccttcctatactgagattaatgactgcaaaaagggctttctctcagaggctgctaatagaggcagttctattcacaataattaacttgcttctcccaattactttaccataaatgtctgggctttgttcaagtttatgttctttttaagatcactaagaataaaatactgtgttgtgaacataattagattttataaacccaaagactctggaattatgctgtggtttatctctttatgaagcaattataccaattatagaagataatgttttaatgggaaatattacccatttggcagacactattggtttaaaataaaagaagtgattaaaaacaacttatgaatctctcttgggtaaaagaatgaaaacaatataacataattgggttctgattcataaaatgaattgtacacaactttcttcgatgctgtagttaagacaaaattacaagaaagtctaacaaaggtttgacagaatgttattatgtgtctttcctactgctaagattacatcattaaaccccaattaatgttttatgttaaggctttcttagccattttgctaatttcacttttcaacttaagataaccacactgcaccttttagatccagaattcccatcaatttcctgaagatgcattcccattatgattattttcaggaatacaagttattatctaattctcataattagcatttagcaacagattaggaacttattcttaaatggtccatttttgtctggggtagtaaaagtattctgggctacttttatgagacggggttgggggggaaccctaaacaacagtgttacagaagcataactctttcctgagattgttggtttaaaaattcaagcaaaacaaaatgctgtttctaaccataaaggcatacctaaaattagagactgtcagagcacaggaaggaaatcataaatagccaaacactggaacacaagtgtgaggtacggaagtcaataaacgttactgttttctttctgttcacatcctgtctgagaattgtattagaggagagcaagagagaaagaatgcaacagtaaaataaagggaatgcatttttatttctgaactacacagtaattcatgaaaacacactttttaaaaatcaaaggaataccagtgtaaatggagtgaaaagtgacagttgctattcactcctttttttcccactcctaccccatcatcaaaggtaatgactctcagcaaattatgaggtttttcctagtatttttatttaaatgataaaatatgatattgtcctatgacatgctatttttaacctaacaatatgtctcagaaatcttcacatgtcattatatgtagctttaccttattcttttaaacaattgccctaataatctatagaataaatttcaataatatattaacctaatctattaatgaacatttaggttatttccaatttttcactagtacacctattcctttaataattcctcttgtacatatgtttatacacatataagaattttgtgtgttaggttgtcagggacagatacctaaatgtggaattgctgggccaagagacagaaaggaagataaaatcatttacattttgcagccaggtgtggtggtgtgctcctgtgatcccagctacttgggaagctgaagtaggaggactgcttgagcccaggagtccaacaccagcttcacaacataccaagaccctgtctcaaaaaaaaaaaattagattttggtaagtattaccaattatttctctaaaaagagtttgccaatattattagtacgtaaaatgtttgccaacctgatgggtatcttgtttgcatttttttagaagatgaggttgaatattttatttgtttattgcttttttgtatttcttattttttggttcacctttgttatattatttggtcatttttctactgagttgttggttatagtcttagtcatttgcaggagtgcttaatataaatcttttctgttatatatgttctaaatacgttttcccagcctgtgtgttatttttttatcttcatgttttcttttgccaaacaaaagttttaaaattgtatgcagtcaatctgttgccatttttctttatgacttctagactgggtatcatgtttagtgtcaaaagacaaaatcacaacaaatttagttcaaagatcttatgtggggccgggtgctgtggctcaagcctgtaattccagcactttgggaggccaaggtaggtggatcacctgaggtcaggagttcgagaccagcctggccaacatgctgaaaccccttctctactaaaaatacaaaaattagctgggaatggtggcacgtgcctgtaatcccagctactcaggaggctgagacaagagaattgcttgaacctaggaggcggaggttgcagtaggccaaaattgcaccattgcactccagcctgggcaacagagcgagactccatctcaaaaaaaaaaaaagatcttaattgaggtcaggtgctttggctcatgcctgtaatcccaaaactttgggaggctgaggtgggaggattgcttgagcttgggaattcaaggccagcctgggcaatatagtgagaccctatcactattaaaaagaataaagaattttaaaaatatttttaaaaaattttaattgtcttttatttgcaattctagaatcggacaacacctcatactataaaacagagtgagtgttctgatgagctgagcagaggaggttgatttaaggaactttcttatcacgctggcgaaaactggcctgtttagggatttggctgttatctctgtgtcctgatttgttgaaaggtcagataaagatcttagtttcagcaggttagtgtggaacttcagcatgactgactccagtttggttttgtctgttgggcctagtacaggagctcagtccaaaccaatgatctattatacatttgatttaacattagtaaaatatgtatttacgctagaacatgtagtggtgtaatatagtctgaacgttgtccccatctaatcttatattgaattgtaatcctcagtattggatggaggttgggcctggtgacaggtgactggatcacaggggcagatctctcaggaatgacttagcaccatctcttttgtagtaagtgagttctcaagagagctggttgtttaaaagtgtgtagcacctttcccttctctctctcttgcttctgctctccctgtgtgagatgcctgctcctgcttcaccgtccaccatgattgtaagcagcccaaagcttcaccagaagcaaagcagctaccagtgccatgcttcatgtatagcctgcagaactgtgagccaattaaacctcctttctttataaattacccagcctcaggtatttcttttttttcttccttttcaaaaacattttttttcaatttcatggaaaagaggtttttcatttttccaaaaattgtaccaaggtaaagcaaagttctagttgatgcaggtgcattgtataggcgttagcaatactgccctcattatgcactcattagacagtagtgcaaccccaagaaaaggatggttagatatttctttatagcaatgcaagaacagcctaacatacggtgatattaagcaatgggagaacagtgggcattagaagacacagatcagattagaatctacctttctggctggatgcggtagctcacacctgtaatcccagtactttgcggggctgaggcgggcagatcacctgaggtgaggagtttgagagtagtctggccaacatggtgaaaccctgtctctactaaaaatacaaaaaattagttgggcatggtggcacacgcctgtaatcccagctactagggaggatgaggcaggagaatcatttgaaccggcgaggcggaggttgcagtgagccgagatcgcaccattgcaccccagcctgggcgacagagcaaaactctgtctcaaaaataaataaataaaaagaatccacctttctcagaccctggctatgtggtttccagcaaacccttaaccaggaggattcagtttctttttccttaaaaaagatcctattaatatcttcctctggccattcgttgagaacattaaattaaataacatttggaaacactggcaggctagtcagagtggctcatgcctgtaatcccagcactgtgggaggccaaggccagtggatcacttgagctcagtacattgagaccagcctgggcaacatggcaaaacccaatctctacaaaaaattagccaggtgtggtggtgtgtgcctatagtcccagctactcaggaggctgaggtgggaggactgcttcagcctgggaggcagaggttgcagtgagctgagatgggccactgcacttcagcctgtgcaacagagcaagatcctgtgtcaagaaaaaaaaagaagaagaagaaagcactggcagagtgcttagcatgaagtaggcactggaggaattttgatacagtaagaataggaatactaggtacctgagaggagaggcagaaaatgtcagtggactaagtggagtgaaaaagaggcgaggaaacaggactagaaaactctaaaagcatgcactcttaggtagtgcagaagtgtttttgtccaactattaaatagcacaaccctaaattcctgtcatactcctgatctttcattttagtgttcaggatctcatagtaaacatgcaaaatttgatattcatttgataacggttgctgtgatacttattgcaaatctcttcttatctagatttttaaaatatatttttttgtagggatggggtttctccatgttgcccaggtcggtctcaaactcttagactcaagagatcctcctacctcagcctcccaaagtgctgagattacaggcatgagccactgcacccagtcttatctacatttaaacaaagtttagcatttattttattttgcggttcaatatagaagatttattttatcttagttgctgaaattggaaatcacttctgtttcaccaaatgaagagattaggattttaagaaactgccagctgctaagtatttgcagattcattctttttttagtattcgttgcacatcccattcaatgtgttactttggagattccatttgattgaatagaggcagcccatgcagaactctttgaagaacaggagggaggctgctgaagcccagagcaatgaagaaaagcaattctaatgtaagaaaaacaaagaacaaaaaaacagaagcactttgcaaacacaataaatgatattaatagattcaacccatcttcatcgctttaatgaaatgataatttttgaggcacttattaaaactcttacattgtcttttccattttgttgcttttgttttactaagaagtagaaatcttcagttagaaaaaaatcagaaaaacatgtggaactacaaatgtaactgatattacaaataggtagactaaactttattttttccttttaagagcttggattaaggtcaaacaatcagaggggattttgggtttttttgttgttgttgttttgttttgttttgttttagaggcagggtcttgctctgtcacccaggctggagtgcagtggtgcaatcatggctcactgcatcctcgaactctagggctcaagtgatgttcttgcctcagcctcctgaataactacgactgtaggtgcacaaaacatgcctggctaatttttttgttttttgtagagatgttatctcgctatgttgcccaggctggtcttgacctcctagcttcaagcaatcctccttccttgatctcccaaagtgctgggattataggtgtcagccaccatgcctagccacaatctgggcttttgaatttcaaatttactatatgccaagtatgtgatgttggacaatcactggagtttcatgttctctccttgtcctactttctgggacagggatactgatcttggtgcaccttgcttgagaaaatttgagttgactctctcctccttgaaacactttcttcctccaagaacaccacacacccctgaccccttactctgaccactcattctcagtctacttctctggtttctcctagtctctttgccacctaaacgttgaaggccccacagtgaaggccttggtttctcccttggtgatcttgtccattcttgtggctttaaacacgatctacatgttataagaacaggctaacccaacatctattttgaactcaagactcaactccagattcaactgtctactagcatcttcatttgtctatcatcaaggtatttaagacccaagctttttcttctcacagatgtcccatctcagtaaatagtgttgccatttttctagttgcccaaaaatcttggtgccatccttgacttttttctttcattcctcacatctactccatcaggaaaccctatccatcctaccttcaaaatatattcagaaattgaatcatttcttaccacctcaactcaaccgcctagctcaaactacagtcatctcttgcctgagttattacaaaagcctcccaaaggtctgtcttaatagccagatgatcctgctacaaccatacttgtctgctccaaatctgtcagtggctttccatcccacacacgacaggagtctgagtcactataatgacctaggaggccccacctggtttacctcttctgtcccaggatcctccattgtaatcactcagctccagatactgggaaccttgtaagcaccccagggtctttgctcctgctgttcccttctgaatcgtgcactagcacgctacctctcggaattcctgttgcctcctattcagccctccccagccattccatgtaaatgacaaacctccacccccatgcattctagtctcctctgctttgcctttcttcacaacactcaccaccatctaaaattgaacatactacacatcctactcattaatcttgttcattgtctgtcagtcactacagtgtaagatccagaaggacagaaattgtgtctactctgttccctataaacctttaatgcttagaacagtgcctggcacatagtaggtgttcaataaatatttgttgactgaatgaatgaacaatagataatggcccaatctagtcattccatctacttctcacaagacagaaaagagtatttcacgaaggcaaagagctttcagacctcaatgtgttttctgaggctcttcctcaatactccattattttatcatcaccattgttgtttttctctaaactgccactctataattgacaagaaagcaacgacataatgtaaaattatgtgtttttattttcatttatgcagctttgttttattttctaggaccactccaatagttattggagtcattgaaatgacagtcattttcaaccatcttctttgctgttgactgaaaccctgtcttcagatagattcatgtggcagagttaataacacctcagtgggcaaacactatccttcctttctctggggggagatatttttagccaccacactaattagatagctctctggctgataatggggcagacaaagggtgtagcatgttaaagaaaatgagcaaacaggtgcaatcaacttagagaatattaatcaaatgtcttttttttttgagatagggtctcactctgctgcccaggctggagagcagtggcatgatcttggctcactgcagccttgacttcctccacttcccaagctcgggtaatcctcctgcctcagtaccccccgagcagctgggactacaggtgcatgccaccaggcctggctaattttttgtagagacggggtttcaacatgttgtccagactgaccttgaactccagggctcaaataatctgcccaccttggcctcccaaagtgctaggattacaggcatgagccaatatgcccagccaaatatcttaatcaccatcatcatcatcatcataaactgccggtaggaagtttggcataatgtgtcacatcaattataaatcacagatgattttacttgatatagttagctagagataatccacagggggtaattttatttattattgttttaaatgctattaaattttgtttttatctagcctgctaattttctgaatgaagctgtaattggcatttgattgatttggctgtgtccccacccaaatctcatcttgaattctcatgtgttgtgggaggaagctggtgggaagtaattgaatcatggagcaggtctttcccatgtggttctcatgataataagtctcacaagatctgatggttttaaaaatgggactttccctgcatgagctctctctctttgccggcccccatccatgtaagatgtgacttgcccctccttgccttccaccatgactgtgaggcctccccagccatatggaactgtaagtccattaaatctcttttttttgcaaattgcccagtcttgggtatgtctttaccagcagcgtgaaaatggacttatacagcatttaccacagtgtctggctcatagtaactgtggcagagcctgctaattgtccgttcaacttccgttctcaaattcttacttcctaacagaacccctatgtcattgatgatagcagttctctcagtgaaaagatacatttctagcctcccttgcagctaggtgtggtcatgtaactgaattctgtccaatgagatatacacagaaactgttagagggatttccaagctgtcttattaaagagtggggacagacaaatggagaatattttcctccctcttcctccttcctgctgactgggaagcgagcatgacatctagagctccagctcctatctgagacaataaggtgacctggaagatagaagttgtgtgctgagtaaggtgagcagaagacagaaaagcccacatctccgatgattttgaggagctgccttggatcactttccttaacttcttttacctgagagtaatgttctaatatcactgttcttgcagattctgctatttgtatttgaattgatcctaatggatgtaatacgtaatcagaaattattttttcagagaatggatggagtacatgcctatggtggttgtagtagtctgctcaggctgccataacaaaacaccacagactggttgtcttaaacaatagaaatttattttctcacagttttggaggctaagaatttaagattaaggtgctggcagggttggtgtctggtgagacctctctttctggcttgtggatgaccatcttctttaccatgtcatatagccttcccttaggctcatgcagagagaaggagagagaaatatttctgctgtctcattctctttgtataaggacattgatcctatcgaattaggtccccgtccttataacctcacttaatcttagttacttcccttaaggccctatcaccaaatacagtcacattgggacttaaggcttcaacatatggattttgggggacacaattctgtccgtaacagcggtcatctattgtcttgccagttttcctcttctaggacctgctcttttcctcctatccacatgttgcttcagtatcactctgattagctagcagcagttgattggtgtgaagtatgcacctgatccaagctgggccaatcaaaggctttccctaggaattgtgcaattaggcctgcgaaagagacagactccttccagtgacagagtgttaggtggcaagttcagaagctgtcagtcttgtttttctccatgtggccagaatgaaaggaagatggcccatagacgcagaataagaagaataataaacagatccacagaaaaggacagaggagagatgaaatgagaaccctgaatgcattagaatcccttgctctaattgttaataatgttcaatcatattcatgactcatgacccatgagaaactttataatacagccttctttcttccttagctacttagagttgggcttctactattttcaattgagagccctagctaatacaactctccaaaattaaaaaaagaaaaaagaaaaagaaaagaaaaaaagctttgtatttttaggctcttagaactcacattattttcttttaataatgattagcaacaactaatggtgtttgttttatcttgtacgctaaattatctgaaattgggtaggtactacagtggaaataaatatttgatgttattttcaataaattgttactggagttaaacctcttgctatcctgacaattcctccctacatcaccctctttgcaatggcagatggaagaattggcaataaatgcaattcagcttgaagaaaacaccctaaatattagaaacctgtgaagaaccaccggattgccttatcaactcattgtgcatcctatttggaagtctaaaatagaactaaaattctaatacttttacttgtataaatgcttataattgtcatctttgcatctcagcaattattcctggataaatatactgcaaatcatctaagaagagaaaaacccctctgaattacatgactgagtttcagaatgtgagtaaagtatggctaaccaaaatgttcaagcaaactgatgcaaatttccttttctatgactgtgtaagcaaaactcttttgcacgatactaagtttgatgtggtgtagcatgtaaaagagaaagcacctttatctgtgtttgagtggaaaccaggtaaccttgtcataaactggggaagaaatgacttaagtgtcagctcccacatctcctgctgtgaatagcctttaggggtgtcataaccacgaacacacaaacttgacagaaactaaatctcagtgcacaaagaaaatgtatctgcaatgaattcatattgggctcttcccacacattatttaacttaatcttccaaacaagctgtgaggtagatattattatcaccattttacactgaggaaactgagtcagagagatgctttttcttgcccagcaccacttaggtcataagtggtggagctggttttgaatgtattcacctcgctcgcaccccatgtgtctgtgctgtactatgaattcctcaagggatggggactggtatttagcttgtgtctttaaattgtcatgaaagactagaggcttcttcttggtagtaagaaataacgtgtacaataccaagaatatagcaattgtactcaagagtatattaaggtcagcgggtgtgtgtaatagaggaattatgaaagacatatctgtgaaacatgctgagattcagcagtaataaattgtttaaaaactaggcttgagaagatgataagagctatttatgacaaacccatagccaatatcataatgagtgggcaaaagctggaatcattccctttaaaccggcacaagacaaggatgccctctctctccactcctattaaacatagtattggaagttctggccagggcaatcaggcaagagaaagaaataaagggtattcaaataggaagaaaggaagtcaacttgtctctgattgcagacgacatgattgtatatttagaaaaccccatcatctcagcccaaaaattctttacactgataagcaacttcagcaaactctgaggatacaaaatcaatgtgcaaaaatcacaagcattcctatacaccaatgatagacaagcagagagccaaatcatgagtgaactcccattcacaattgctacaaagacaataaaatacgtgggaatacgatttacaagggacatgaaggacctcctcaagaactacaaaccactgctcagggaaatcagagaggacacaaacaaatggaaaaacattccatgctcattgataggaagaatcaatatcgtgaaaatggccatactgcccaaagtaatttatagattcaatgctattcccatcaagctaccagtgactttcttcacagaattggaaaaaactactttaaatttcatatggaaccaaaaaagagcctgaatagccaagacaatcataagcaaaaagaacaaagctggagccatcacgctacctgacttcaaactatactacaaggctacagtaaccaaaacagcatggtactggtaccaaaacagatacatagaccaacggaacagaacagagacctcagaaataacaccacacatctacaatcatctgatctttgacaaacctgacaaaaaaagcaatggggaaaggagcaatggggaaaggactccctgtttaataaatgatgctgggaagactggctagccatatgcagaaaactgaaactggatcccttccttacaccttatacaaaaattaactcaagatggattaaagacttaaatgtaaaactcaaaagcataaaaaccctagaagaaaacctaggcaatatcattcaggacataggcctgtgcaaagacttcatgacgaaaacaccaaaagcaatggcgacaaaagcccacattgacaaatggaatctaatcaaactaaagagcttctgcatagcaaaagacactatcatcagagtgaacaggcaacctacagaatgggagaaaatttttgcaagctaaccgtctgacaaagatctaatatccagaatctacaaggaacttcaacaaatttacaagaaaaaaacaaccccatcaaaaagtgggtgaaggatatcaacagacacttctcaaaagaagacatttatgcagccaacaaacatatgaaaagaagcttatcatcactggtcattagagaaatgcaaatcaaaaccacaatgagataccatctcatgccagttagaatggtgatcattaaaaagtcaggaaacaagagatgctggtgaggcagtggagaaataggaatgcttttacactgttggtgggagtgtaaactagttcaacaattgtggaagacagtgtagcaattcctcaaggatctagaaccagaaataccatttgacccagcaatccgattactgggtatatacctaaaggattataaatcattctactataaagacacatgcacatgtatgtttattgcaaccctatttacaatagcaaagacttggaaccaacacaaatacccatcaataatagaccggataaagaaaatgtggcacatatacaccatgcaataccatgcagccattaaaaagaatgagctaatgtcctttgcagggacatggatgaagctggaagccatcattctcagcaagctaatgcaggaacagaaaaccaaacactgcgtgttctcactcataagtgggagttgaacaatgagaacacatggacacaggaatgggaacaccacacaccgaggcctgtcagggggtcaggggcaaggggagggagagcataggttgataggtgctgcaaaccaccatggcacatgtatacctatgtaacaaacttgcacgttctacacatgtatgccagaacttaaagtaaaatttaaaaaatttaaaaaataaaaaataaaaaaaaaattaaaaaaaaaaaaaactaggcttgagaggaaagcacaagtagtcaccaccaccagcgcagcagtgccagagccaggaggagatcccggccactgcccctgcctcccgcctgccgtcagtcgcctccatcctgttccagcaatctcttaaagcatgatgggttaggctgggcacagcggctcatgcctataatcccagcattttgggaggtcgagccaagtggaacacctgaggtcaggagttcaagaccagcctggccaacgtgctgaaaccccgtctctaccaaaaatataaaaattagctgggcatagtgacacaagtctgtaatcccagctactcaggaggctgagacaggagaatgtcttgaaccccagaggcgaggttgcagcgagccaagatggtgctactgcactccagcctgggtgacagaacgagactctgtctcaaacaaacaaacaaaatcatggtggattactatgaaattctaggagtgtggagagaggcctcacccgaggatattaaaaaggcacaccagaaactggcactgaagtggcacccagatgaaaatcctgagaataaaaagcagagagaaaattcaaacaagtagctgaggtgtgtgaggtgttgtcagatgctaaaaaacgggacatctatgacaaatatggcaaagaaggattaaatggtggaggaggaggtggaagtcattttgacagtccttttgagtttggcttcacattctgtaacccagatgatgtcttcagggaattttttggtggaagggacccattttcatttgacttctttgaagaactcttttgaggacttgtttcagaatcaaaggggtccccgtggaagcagaaaccaagggtcggggtagtttttctccacattcagtggatttccatcttttagaagtggattttcttattttgatataggatttattaatacttcatttgggtcactcggtcacgggggcctcacttcattttcttccacatcatatgttggtagtgggatgggcaacttcaaatcgataacacttctactaaaaaggttaatggcagaaaaatcacgataaagagaattatcaagaatggtcaagaaagagtagaagttgaagaagacagccagttaatgtctttaacaataagtgttaaggagcagctgctgcacttggataacaagtaattcaaggcgcccacttaacagaaatgttaaactataacaagaaccatctgaggattaacagaaactttttttttgtagatttcaagggaacttgcctttcagaataatagtacctaaagtatttataaacagctaatcggaacctctatttgtcataggcttttgagtttattgttgggacccataataggaccattttttctttttgtcttcaaaattattgtaggccaggtgcagtggcttacacctgtaatcccagcacttcgggaggctgaggcgggtggatcaagtgaggtcaggagttcaaaaccagcctggccaacatggtgaaactccatctctactaaaaatacagaaaagtagccaggtgtggtggcaggcacctataataccggctacttgggaggctgaggcagaagaattgcttgaacccgggaggtggaggttgcagtgagccaagatcacaccattgcactccagcctaggtgacagggcaagactctgtctcaaaaatatatatattattgtaaatgtctgtatgctttttgcccttttattaaatgtactccaaggtgagccttgactctttagtgtaggacaagactgtgcactaacaccagcatggatctgcttttccattgtgtctgaaatgtgagccacatagtgttggcctgctgtgaggtcaccattgccagggcgaatcttctacagaactaaattcattttgtttttcagtatgtagtagtaaaagatattaatgcattaatggtaatacatttctggtttaatataaattaagggtgttttctagctgagcctgaatcctgtcaactcagtaagtcttgacaattgtttaaatatgtgatgttaagcttaggtttaaaaaagcaaagcaggtaaagtgggtctttgtcatttgctttttttttttttcctgagatggagtctcgctgtcgcccaggctggagtgcagtggcgcgatctaggctcactgcaggctccgtcccctgggttcacgccattctcctgcctcagcctccctagtagctgggactgcaggcacccgccacctcgcccggctaattttttgtatttttagtagagacggggtttcactgtgttagccaggatggtcttgatctcctgacctcgtgatccgcctacctcggcctcccaaagtgctgggattacaggcgtgagccactgcgcccagccgtcatttgcttttttaaaaaagaaaataaatgcaaatgtgtttggtgcaaataaataaacaaataaaaactaagtttgaccactgaacacaatgcataatccaggactgactcctatgctgagggtgaatgtgatgggagattctctctcagggatactattgaggcattcaacaaaattttaatatggattatagattataaaaagaaattctgtatcaatgtgaaattttctgcatttgatatctctgctgtggatattttaaaacatttttattaatatgaaaacacagtgaaatattacagcaaaagggccattatatattcaagcaacctctctcttggatggtttagggaaaaaattatatctctaaacagagagagtgagagagagaataaaacaaacgtggtcaggcgcggtggctcatgcctgtaatcccagcactttgggaggccaagatgggaggatcacctcaagcgatccaggagttcgagaccagcctggtcaatatagcaagaccttgtctctatttaaaagaaaagaaaagaaaatgtggcaaaaagttaaaaatagctaatctggtaaaaagtataggagaattctttgtatgtattgttttcacagtttttctggaagtttaaattattacaaaagataaggttcattagaaagaccgctaggcttagactcaggagtcctggttttgggttcagatttcccattatccatctgagtgacatttgtcatttcacagaatttctctggaccacgcccctcttctgtaaaatacaaaagttatttgttttaactgtggattggcattccattatagaaacaaatagctcactcattcctctaaactgagtggtttctatttcttccctgttatgagcagtgctgcagtgaacggctgtattcattgttccgtgtgctcacgtgcaggtgtgtcctagggcacagccatgttgatccatgtgggtaaactaaaaaatgtaacatcgagtgaaaaaaagcacactgaaaatacactaaatatgattcaatttatgtaaattttcaggcactaacatacatcataaaagtacaaaaacatacatcagattgatatatgccaacatcaccttagagcttacctctgggcagaaagggaggaagaaggaaggagtagagtgggctgtagttacatctatgttttttcttcttgagagagtgagagattgatctacggtaagggtgggttcagctaacgactcttggtgtcttccagcgctaatgatttataattaagttagatttgtaaccttaaaatactttatagcatttaccctgcttgtgagtgtgtatagatttaacagaattcaacaagcacgtgctgagaaaattctttacccagggcattcagctacctacagtatagtcagagggaaataaaacatggtttggaatgctttgagggaaagaggactctgatgtggtattaaagataaagttggttaatcatttccttgagataatggcacataagctacaattaaaggagaaactggacatatgagggagggaggactttgttagcgctatgcttttaggcatatattccttatgtgaatatttattcttagcattgttggctcagtgaatggcctaggaaagttacattccagaaggaaacatgttattacacataggaatcgattggtcctccatgagtacctacaattgaattctatgtattaaaaccgcagaaaaacacatacagatagaaaatatttttaatcaaggactagtatccaaagcaaaacaaagtggaaatttggtaattatcctgtgaatttctgcaacttaacaaccaaactggataatttgagcaaggagttcatctattgatgtgtgcacacccttacagcaaaacatctctctctatctctgagagtcatcttaggcaattgtgaacagaaggcgtttatccatcagggctcttttagtaccaaaaaacagaaaacctgactccaatgaacttaaatgaaactgaaaggtccaaggatagatttttaacttcaagcacaccttgatccaggagctcaagcaatggcattgtaagggagcctaaagaccccctctacccatctttggggttttgggtttttgattttttgtttttgttgattgttttgttttgtttttttgagatgaggtctggctctgttgcccaggctagagtgcagtggcgcgatctcggctcacggctctcctccatctcccgggttcaagcaattctcctgcctcagcctcctgagtagctgggattacaggcacacaccattacgcccagctaatttttgtatttttagcggagacagggttttaccatgttggccaggctgctctcgaactcttgacttcaagtgatctgcctgccacggcctcccaaagtgctgggattacagacgtgagccaccgtgacttgcccatctttgtttttaagtaaaatcttctgctgggtctaggagctgttactgaaccaaacttcggtggcacagcaaagccaaacactgacatcaggatttgcagctggagaaaatgaggcatttattgcagggcaccaagcaaggagaattggcagcttatgcttaagatcagaactccctaatggcttataggtaagagtttttaaagatggggaggcacgctgggcacagtggctcatgcctgtaatcccagaactttgggaggctgaggtgggaggattgtctgaccccaggagttcaagaccagcctgggcaacatggcaagaatgtgtctctatttaaaaaataaataaataaataacatttttttaaaaaagatgggaagtcaaaggttccaggcaaaatcataaatcagtacatggaggttatatattaatttgacctaaaaaggcaggacctctcaaactggggtgcggggtggcggtggcccacaggtcataggtggattcaaaaagattctctgatttgtgatttgttagggaagcaaagctttgtctaaaaacttggcatcagcaggaagaaatgttgagctctggcctgtgggcaggacttccttcaggaccctcaggaagaaatttaggacacaggatggtgatcagggttcagtcctcagtgctcccttatctgaggtctatgtgccagcagatgacattttccattgggtagcggtccaggtttctgaaaaacaacttggggccggagatgttatctttagtttctacatggagccaaacattttgggactttaactttcctggctattgttttaagctgttattaccttcttgattatcaggttgctcatgtacttctcaaggctagctgggtgcctggaatttcccttgaaggtactcaagactttcctttatttccatgtttgaaggaagtccccaggaggcccctaaaagggttccctgctccatctcaaccaaattgatacaagatagattaataggacaaaagcatacaggttttattaattttacatatacatggggatcctcacaagagagggaagacccaaagaaatggccaaagcagaaagcttttatacctttcaggcaaagaatgatacattttgtgaagaaatgacaagactgggtctgggctaggggcagtaaattctagggtaatcactaagagatatatggagggctgtaaggctagtgaaagaggaggattattttagtaagcttatttattcggatccattgcagcatcacttctcagtcatggctaataagggttatcttctcatgctggaacaggcaaggcagctttttctttctttctttctttctttctttctttctttctttctttctttctttctttctctctttctctctttctctctttctctctttctctttctctctttctttctttcctttaagttctgggatacatgtgcagaatgtgcacgtttgttgcataggtatacacgtgccatggtggtttgctgcacctatcaacccgtcatctaggttttaagccccacatgcattagctatttgtcctaatgttctccctccccttgtcctctgccccctgacaggcccctgtcaggggatgttcccctccctatgtccatgtgttctcattgtttacctcccacttttgagtgagaacatgcggtgtttggttttctgttcttgtgttagtttgctgagaatgatggcttccagcttcatccatgtccctgcaaaggacatgagctcattcttttttatacctgtaccttcctttctttttttaagagatgaggtgtcactttgttactcaggctgcagtggagtggtgtgatcatagctcactgcagccttgaactcctgggctcaagcaatcctcctgcctcagcctcctgagtagctgagactacaggtgtgcaccttcacgcctggcttgaaggcagctttctcacaggaatttttatggcttgctataggtaagaaagggcagttcagatggtgctttctgcagctgctgcttctcaagtgctttcagctagaaataaagtacaagctgagcattttggagcattatatccttaacctcttcagcatcaagactgtttcttcccatttcttgacttgtctttctgcaatgttggcatcatttctaggcttacacatatacctccagactcaggtcatccttactgttacagtcctggaaaaacaagacagcctcagctcagtagttcccatacaaattccaatgtttagattgtttggcataactggagtcacatgcttatccatgaactaaataatcatcgttgacaggaaatatggtattctcattggccaggtcaagtcacatgctcaccagaggggtgatggggaactagctccactcttgcgcgtattagggaggagatgttctcagtcaacacttctcaaacttgaatgtgccttcaaattgccaggggagcttttaaaatgcaggtttttcctagcactttgggatgccaaggtgggcacattacttgagctcaggagtttgagaccagccttgccaatatggtgaaatcctgtctcttctaaaaataaaaaaatgagccgagcgtgctggtgtgcgcttgtagtcccagctactaggtaggctgagacaggagaatcgcttgaacctgggaggtgggggttgccgtgagctgagatcgcaccgctgcactccagcctgggtggcagagcgagaccctgtctcaaaaaaaaaagttaattaattaattaaataaaataaaaaataaaatgcagattctgattcagctgttctggaataggcccagagaggctgcgtttccaacagcccttttcagatcagactcccaaggtgcatgctaatctgctaagtattacgagtgtagttagttgaagtcactacagtagtagtagcagtagtagtagcacagtagttagtttgcactaggcccctaatatgagggtcctagtgcaaaatgagaatgtggggcccatcagtcaacaattattaagaatttaaaaaaagtgataacaaagcatttaaccaaacacagagctattctactcttggagcgtgtgcagcttcacaggtcacatgcccatggagccagccttgattgtagccttctgttttgacgagtttgagttggaaccagaacaggattgctgtaaacagtaggggagaggcagaggcagaacctgtggtccttctctgctctcctccaaacagatttggcctcatctttgaatgaatgttgaacatttgaaaaccaaccacctttctgcaggagcactagttatccgcctgtttgtggagcccatatatctcaatccagttctcgtcaggagatccatgaaatgctgaccttttattcttaattgccactgactttgcctccatattaggctagatgttcttgctttgtgtctccaaaggcctttacactttcacaaccataacccttcgcatgtattatttccattaactagtttggtcgtctgtctttcctcctggactataagctcaaggaggggtagagacagtgtctgtcttgtttatctttgtggcccatttctttagtatggtgcctggagtaacgcttcaaatatacattaactgagttgacaattagagtaatagttaacatatctggcattgtcagatgttttaattttagcaattttggtgggtgagaagtggtatcctattgtggttttaatttgcatttcccagatgactaataaggttgagcaccatctcatgcatttattgaccttttgaataccctctgtattcgtgtgctagggttgtcataacaaggtaccaccgactgggtgactcaaacatcagaaatttactttctcacaattgtggaggctagaagtctagaagattaaggtgttggcaggtttgctttcttctgagggctctctccttgacatgtagaggactgtgttctccctgtgtcttcacacggtcttcccccgtttgtgtgtgtcctaatctcccctttataaggacagcagtcatattgaattggggcccaccccctgacctcattttaacttaattacttctttaaaggcactatctccaaatgcagtcacattctgaggtactggagttggggcttcaacatatgaacctggggggataccattcagctcataacatcttttttgtatgagtgtctcttcaagtctcttgtccatttttcttttgagttatctgctgatagaagctcttgatatctctttgactcgagccttttcttcaggccctctgctgttggttacatgggttaccactatctccatccattcttctaatgatatcttccaataaattgaagtccctaattttaatatagtccaatttgtcaatgtttccctttacgactagtgcttttcttttttctatttagaaaatctttgcttcctccaaagtagtgagacattctctatgtctcttcaaaacttttgtttgttttacattttatatttagacatatgatccacctgaaatttctttttatgtatggtgtaaggaagagttcaatatgtatttttcgaaacatatatttaattgatccagcaccattgattgaaaaaaaaacatattttcctctctgctcttgcattggatctataagttattccgcagaaaaattggtattttgataacattaagtctttaagtctatggttttattatcatgaattctgcttaggacttcttgatatttatctttcttaaatctgtggcttgataacttttgtcattttggaaaactctcagagatcatctcttcaagtatttcttctgctatattctttttcttctgtctgtggaatccagttacatgtatgctagacctttttattctgtttcatatgtctcttagatctttttgtctttccctgcttcagtctgcatattttgttctggcctgtattccaatgtacttattttcttttcagctgcatcagttcttgctttgtaattgtattttttcagtcctagaatttccatttgattaatttttatagttgtcacttctctgccaaacttttccattttgttatttaatttcttaaacattaacttcttaatttaatttgtttagttttatgagaactaaaatgctcattaaaatacacatttaaaaattccaatatttatatctcccatggctctttccagttaggggtcaattatatattatttttgtaggccgaattatttcttaactcacctctaaacatttgtatgtgaaaaattataagagcaatttgaggctttggaaaatgttctcttcctccacagaggattaacatttgcttctggcagcaagtttggccagaagtaggtcatcttaatgcaatctgggattaaaataatccaaagctaggcctcagttcttgtgaagtctgttctcattcacatttattcctgagatgatgcccttcaggatccccgctgaatgcctgaagtgtctaccagggaaccttttctagccttttctagctttgtcttttttttcctccacttttttttgtccctacagctcacaggacacctcgtggagctcctcagccaccagccactttgtcgggttcctctaaggggaaagagagtccaaataccaggctcacatatctaggttttctttttcttccaagacttggtcctgcaaattctgtcttccctggtctcttgtcaattaggtttagatgggaaaatatataactagaattggtttcttagaagctgactttctgagatggttctattgtcaggtctgttgagttgtgctcaggtgtctgtctcttgtttgcctcctggtactgcctgaacaaagagcatcatcaccaatccttgtgtgatggttactactgagtgtcaacttgattggattaaaggatacaaagtattaatcctgggtgtgtctgtgagggtgttgccaaaaatattaacatttgagtcaatggtctggggaaggcagatccacccttaatttgccttagcttccagcgaatataaagcaggcagaaaaaatgtgaaaaagagacaatgggcctagcctcccagcctacatctttctcccctgctggacgctacctgccctcaaacgtcaaactccaagttcttcagttttgggactcagactggctctctttgctcctcagcttgcagacagcctattgtgggatattgtgatagtgtaagttaatacttaataaactcatatatatatatatgtatgtgtacatcacacacacacacataaacatatcctattagttctgtccctctaaaagaaccctgactaatacagattttggtaccaggaatggttctagaggaacagaatattaaggatggagttctttagttggttttggggtttctggagttggctgcttaatatgattagaccccacaatgctagggactgtacttccaatagtatagataacactgatagtccttggcatgagctctttagagagttatgcaaaataaatgcatttgatgctcctaattcaccactcatgagaggcaaggagtttagtgactctatacatagtaactttgaccatatgtggagaaccaaggaacataatgaagctggttggttgctcctaaactcagtggacaaagtgattacagaaaatgatgaaatcagggattctctgtcctggcttcagaagcagatactgagcctcaaatctgctaagatttccctgagtgagagtcttgtttcctgtagagaaagagctgaaattgtggacaaacagacacgcgctcttattatgtgagtggctgacctgcagtgaaagatgcgtgcacagcctcgccaggtgtctactgttaaagagagggcattgattggaaaagaatgggaccctgcaacttggaatggggacgtgtgggaggaccctgatgaagctgaggacactgagtttgtaaactctgatgaacttttttgccagaaggaacagcttcctaatccccagtagtggcaacatcccctcctggacccacgctgccatcagcctttccacctttgtctgaggagataaaccctgtgctgcctgaggcaacagtgatggcctcccctgaggcagttgccaggcaaggtaatgctgattttcctcagaagtcacactcatcacctctgtttgcttctagacttacaactagatgaaagtcctggcgggcccctagaggtgaggttgagagtgtgacccataaggaggtgtactacacttgaaaaaaactgtgagttttctaattaatataaacagccatctggagaacaggcatgggaatggatattaagggtatgagataatgttggaaggaacatagagtaggatcaggctgaatttattgatttgggcccactaagtagggactctgcatctaatgttgcagctcagggagttaaaaaaggttctaatagtttatttgcttggttagctgaaatatggattaaaatatggcccactgtgagcgagctggaaatgcctgatctctcttggtttaatggagaagaagggatccaaaggcttagggagattgggacagtggagtagattagtcactttagacctctcatcccagctgggaggatccagaagatatacccttaactaatgccttgtgaaatagatttgcgagggcggcacctgcatctttgaagagtcctgtaatcgctcttctctgtatgtcagatctaatagtgggaactacaaaatttaaatacaatgggaatgatcagatcacaaggtggcaggggccaagtagcagcactcgactgtcaaaggcaaggtggatgtagctcctgtaatggacagcagaggcaaagcagaaatcagaatagtctgactcatgtagaactctggcattggctaattaatcatggtgttcctagaagcgaaattgacaggaagcctactgcattcctatttaaagtacacaaacagaaaacttttaggtcgaatggacaaaagactaatttgaattataaaaacagagagtcacagcccctcaatcaatttccagacttgagccagtttacagacttagaaccccttgaatgaaggggagccgcatccccttggagaaggaccccactacattaccgacaatttattcagtgaatttttctcccatccttccccaaggagacagctgactttttaccagggtaactgtgcactggggaaagggaaatgatcagacatttcagagactacttgtcactggctctgagctgatgttgattccaggggatccaaaatgtcactgtggtcctccagttaaagtaggggcttatggaggtcaggtaattaatgggctttggccgaaactgaacgtttgactatgggtcatcaggtcaccatgtgacctgaactgcctatcatgaactgggtgctttctgacccatctagccataaagtgggtcacacacagcagcattccatcatgaaatggaagtggtatacacgtgataaggctcaagcagttcctgaaggcacaagtaagttacatgaggaagtggctcaaatgtccatgatctccactcctgccaccctgccttttctcccccagcctgcactgatggcctcatggggagttctctatgatcagttgacagacgaagagaagactaggacctggttcacagatggttctgcacaatatgcaggcaccacccgaaagtggacctgcagcactatagcccctttctaggacatccgtgaagaacgacagtgaaggaaaatcttcccagtgggcagaacttcgagcagtgcacctgcttgtgcacttcacatggaaggagaaatggctagatgtgaaattatatactgattcatgggctatagccaatggtttggctggatggtcaggaacttgaaagaagcatgattggaaaattggtgacaaagaaatttggggaagaggtatgtggatggacctctctgaggggtcagaaactgtgaagatatttgtattctgtgtgaatgctcaccaatgggtgacctcagtggaggaggagtttaataatcaagtggataggatgacccattctgtggacaccactcagcctctttccccagcaacccctttcatcgcccagtgggcccatgaacaaagtggccatggtggcagggatggaggtttcgcatgggctcagcaacatggacttccactcaccaaagctaacctggctatggccactgctgagtgcccaatttgccagcagcagaggccaacactgagcccttgatatggcaccatttcttggggtgatcagccagctacctggtggcaggttgattatattggacctcttccgtcatgcaaagggcagaggtttgtcctcactggtagacacttactctgggtatgggtttgcctatcctgcatgcaatacttctgtcaagactaccatccatggactcatggaatgcctcatccaccatcatggtattccacacagcattgcctctgaccaagggactcactttaggggtaaagaagtgtggcagtgggctcatgcttatgaaattcactggtcttaccatgttccccatcatcctgaagaagctggattgatataatggtggaatggcctattgaagtcacaattactgtgccaactagatgacaatactttgcagggctgggacaaagttctccagaaggccgggtatgctctgaatcagtgtccaatatgttactgtttctcccaaagccaggattcacaggtccaggaatcaaggggtggaagtggcacccctcaccatcacccctagtgatccactagcaaattttttgcttcctgttcctgcaacattatgttcttctggcctagaggtcttagttccagagggaggtacgctgccaccaggagacacaacaatgatttcattaaagtggaagttaagattgccacctggacactttgggctcctcctacctttaagtcaacaggctaagaagggagttacagtgttggctggggtgactgacccagactatcaaggtgaaatcagtctattattccattacagaggtgagaaagagtatgcatggaatacaagagatccattagggtgtctcttggtattactatgccctatgattaaggtcaatgggaaattataacagctcaatccaggcaggactacaaatgacccatgaaggttgggtaactccaccaggaaaaaaaaaaaaaatatatatatatatatatattcataaggtctgtttgtacagaattcttttgatctcaactttctgactttgatgataacaatgttactttccttctggtacagggaggacatcttccatatgagagttttatttcctgttttctgtgacatttcacaatcgcttggtcaagtcttattgtgaagttgtggagtgtgccaccttactctccctgcatattttttttttttttttttttttagatagagtatcactctgttgtccagactggagtgcagtgatacgatctcgtctcactgcaacctccacctcccatgttcaagtgatttgcctgcctcagcctccccagcaactgggattacaggcacagaccaccacgcccagctaatttttgtatttttagtagagacagggttttaccatgttggccagcctcatctcgaactcctggcctcaagcaatccaccctccttggcctcccaaagtgttgggattacaggtgtcagccaccatgcctggccccctctgcatctttctgccccatccacagagtacccattctcttcttcctccaagtcattctcctctctgtttcaagagtgacttaaaaagaggattagttcaatgttttcagtccctcaatagttctctttatagtccaggacaaaggacaactatcttccctagaggtaacatgcctctctgcctttgtcctctgccaggaaaacccttcttgcacctgctgtttttttttttttaaggtaccttgagcttaaagtaatctttatgccaaagtggcatattttgaggtgacctattctactgccattcacacctcgtgaatttttgtgtctcacaggaattatgcaaacctccccaagctcaacctgcactttgacttcttgcttctaaccatactattccatcaccataaatggtccttccacaatcttttgtgcctgcaaagttcctattcatcctcctggacccacctcaagtgtcacatccagtgccactctgtttttgattccctaggaatgagtcagatcctcttcggattattgccatagcagtgtgtacattttgtaacttattcttgcacatatcatgcttttagaaaaatctttatatctgttttcctcccaaaattgagaacagactgaggacattaaattctacccatcttgatattctcagcaattagcactgcacactaaatgattggttaaacaaatgttcaaatatgagcttgaggaagattaaattggcaagaatgattaggagaataatacaaaggcaatgaaatcaaatactagtaatgacaataggaatacatagaatatcaaggtggcaaagttaaaaggatttaacaatcaagtaaaaggaaggagagaggaatacacagaattgactccaaatcaaaattctttagttgtacacccttttgaaaatctaaaggaagttaaaaacattcattcctgaaaaaaaaaatgcacgtatgcctttttgcatattaaatgaggagattcctttcttaaatgtcctcaactcaagtttacagaccactttaaactgtgagactagatggtttgcaaggtagtgataccattaactgacctatgaacatcttgaaaaatagctgggttagaggagtagaggaaagttgggttttaatcatatattaagttggtacaaaataactgtagcttttgcattaaaagtgatggaaaaactgcaatttcttttgcaccaacctaaatagaagcccctatagtgttcacagatttgactactttggagatacctgaggtgcacgatgtgtagtaatttgtagtgatgccaaggcacattcaaatcctgaggcactgctacaaaacagcaactcacttagtagcccagctgggagcctagcaaataaacctcaactgatttatatattggtcctaccaaagtgaaaaagatcagtttctgaagtggatatatgcaaaggaaactcaaaactctaaaggataagtttaaattatcgacggaagcaagcattttccatgagagaatttgtagatatattaattcatgttgactctcaaggtttactgcgtttgagtttggagacagaggtgttcgttaagttgaaacagcactggaaaagaaactgaaattaggattgtgatttgagagtctttcctgctaaggagtgcatttcaacagatctaagtgtgagattactaaatgtgataagcagaattctaagatagcttatgattctccttcccttgtattcacacccgtatgtagtgccctcctctttgagtgtgggtagaaactgtgacccgtttctaaccaacggaatatggtataggtgatagggatatcacacctgtaattgtgctacttcatgtggcaaaagtgaaggtattttgcagctgtaattaaggtccctaatcagttacctttgtgttaatcaaaagggagcttatctaggatagacctcatctaatcagatgagccctttaaaagagggactgaagccctccctgagttcaaagaaatcttcctgcttgccttgaagaagcaagccaccaagagttcatcagatgcaaggaaatgaattcagccaacaaccctgttgaacttgggagagaacaaaaacctcagatgctgtcatagccccggtccacacggtgactgcagacttgtgagactccaaacagagaacatagttaagttgtgcctagactcctgagctgccaaaaccataagatgataatgtattgttccaagccctacatttacggcaattcatgacgtagcagtagaatactgatacaccaaaggaaagagaatatggagagaagcaaagatggtaaaaaaaaaaaaaaaaaaaaaaaaattctgacaaatgacaaatgtacctgcctttgaatgagtggggaaaaaaataaggacagtaaggggaattaaaagggaggatgatcaggcagagacatccagaaaataatatggcagactagactgatacaggaagctctctctaactccgaacagatagaaatcctattattttttctttttttccccaatgatctaaacatgttttttaattgtttaaaatatatagccacgcaaaaagcaagaaagaacaaccccatatgccagaaatgaaaagaggcccaaagtaagggcatcaagtgagagagaaaacagaacagctcacaggagtaaaagaaacaattataggcctttaggactggagttttaatactgcttaggagagttaagtgatcagtcttggacctgtgcttgatggaaatcttgcataaccctgggaaccacacagggctgtcccattagtgagaatgggaaaaagaaaactccaccaaaacaacacaataatacaataaaaagaaataagaagaattagaagtgaagagacaaaggtttcactatttttaggtgatataatcatttgcatttaaaagatacaagataaactattataaccaataaaataaactgttgtaacagattgttataaagtttaccaaaacaagatcagtatataaaaagcactagtgggccaaacgtggtggctcatgcttataatcccagcactctgggaggcagaggcaggtgaattgcttgagtccaggagttcaagaccagcctgggcaacatagcaaaatcccttttctactaaaaatacaaaaaaattagctgggagtggtgttgcattcctatagtcccagttactcaccaggctgaggtgggaggatcacctgagcccaaaaggtcaaggatgcagtgagctgagatcgtgccactgcactccagcctgggcgacaaagcaagactgtctcaaaaaaaaaaaaaaaaaaaaaaagtgtcccttggttccagcaacacccaattagaaaatgtaaccaaaagagttcttttatcataatgacaaacaacaaagttagaattaacataataagtaatgccagaattttgtgtgtaaaaaattttaagtaaacattatttacaaaataggtatagcaaacatatagctcaaaattcaaagatacaaaaagaaatataactttaaaatctcctcccatctttcccagccatccaatttccttttctggggcagtcactctttttttcttttgcatttttttagagatatcctaggcatacataggcaaatatctttttcttattgttttacaaaatgacagcatagtagaacattcatctgcacttcacttttttcacatatgaatatatcttggggataattcacatcagtacaaataaagctgtttcattgttttaaagtgaagcatcatattccttgtatataaccaacaccatataaatggaaattggtaccaacaatgttattgcaaaaatccctggacatacatcattttccacatttccaagtgcaagaatattttaagttcaaattgctagatgaggaattgttaagtcaaaggttatgtgcagttaaaattttgatagctaaaacaatagccctccatagaggttacgctaatgtacatggccaccagcaatgtaggttaatgtactgttttctctcaatttttctctccatctcagtgttttttttcaagtttttatctttatcaatatgatatgtaaaaaaatggtctcatgcaaataaaacagggaaagatattgcttcacattcagtaggatggctataatcagaaagatataacaacaggttttggtgaggctgtggaaaactcagaaccttcatatactactgatagtaggaatttagaatgatgcagccattttggaaaacagtctggcagtttcttgaaaacttaaacatactatttaacccagcaattttactcctaggaatatactcaagagaaatgaaaacatatgtccatgaaaaatttgtatatgaatattcatagcagcatcattccactaaaacagtagaataatcaaaatgtctatcagctgatgaatggataaacaaaaagcaatgtataaatacaacggaatgttgttcgtctctaaaaaggaatgaagtactgatacacgccacaatacagataaaccttgaaaacgttatgctaagtaaaataagccagttgcaaaagactacatattacataatttcatttgcattaactatctagaatagtcaaatctatggatacagaaagtagattactgttttgcaagaatgtggggtgcagggagagaggggctaaggatgataactaaaggctactgtatttattttgggggtgatgaaacgttctaaaattgattgtgctggacacggtggctcacacctgtaaccccagaactttgggaggccgaggtgggtggatcacctgaggtcaggagttcgagaccagcctgaccaacatggtgaaaccctgtctctactaaaactacaaaattagccaggtgtggtggcacatacctgtaatcccagctactcaggagtctgaggcaggagaattgcttgaacccgggaggtgaaggttgcagtgagccaagatagcgccattgcactccagcctgggcaacaagagggaaattccatctcaaataaggaaagaaaattcattgtagtgatggttgcacaactgtgaaactattgcaaaaatggtctcggtatagttttaatgtgtatttctattattaatagtgaagttgaacatcttttcatatatttattagcctttcaggtttctccgcctatgaattgtctatttttatcaattacttatttcctattcattttcttttctttatcaatgtacaggagttctttgtgcattttagcttcactgagatgctttacagattggcaaaaattagaaagttcatgtggcaggcagaaaaaaaatgacctcccaaagagatctacatcctaatccccagagtctgtgaatatgttaggttacatgacaaaagagaattaaggctgcagatgggattaaggttgttagtgagttgacttcaagattgagaggttattcaggtgagcccaatgtagtcacaagcattcttgtactatggaagaaggagtgagaagaaagagtgttagagtaataggaggtgagaaggatttgactggctattgctgtgtttgcaaatggaaggaagccatcataagccagagtgccagtagctgtagcagctaggaaaggcaagaaaaagaattctctcctagaggcaccagaagagaatgcagccctgccaacacgttggtttttagctcaaccatacccatttcaaacttcagaccttcagaactgtaaaagtttgtattgttgtaagccagtaagtttttttgtttttttgtttgtttgtttgttttgagatggagtctcgctctgtcacccaggctagagtgcagtggcgcgatcttggctcactgcaagctccgcctcctgggttcacaccattctcctgcctcagcctcccaagtagctgggactacaggtgcccaccaccacgcccagctaattttttgtatttttagtagagacggggtttcaccatgttagccaggatggcctcgatctcctgacctcgtgatccgcccacctcggcctcccaaagtgctggaattacaggcgtgagccgctgcacccggccataagccagtaagtttgtagtaatttgttgcaaagcaacaggaaacaaataaagttggataagacaaaattctggaaaggatgtgggcaaacatatttttatgtggtactcatatgaatgccaactggcacagccaattttggagagcaatgtggtagtacttagtacaattgagtgggtgcatctcttatgacccagcacttctgtttctggatacacacctcatagaaacacccagatatgcacacaagggacatacattaggatgttcttttatcaaggtattatttgtggtagcaaggaattggaggcaacctagaagcccatcaatatgagcatggccatgtaaatgtggcttatgctggtgatggaatgctatgcagcaggctgaaagaatgaagctacttgtagcaacatggattgactataaaaacataatgttgatggagaaaaaacttaaaagcagtattaaatctataacatactaccatttatttaaaattttaaagcatatagcaatgtattttatcacagatccatatgtatgtaaataaacacaagggatgtgaattgggaagatatttataaataagagtgtcaatggagtagaaagaagaatagcattgagatgaatgataaatgaagggaaaagaaaataagataaaacaaaaaattaaaaggggatgtggatttaaaaagacaattgcgtactgtgaactccgtatactgacaattttactcaacccaattctgtacatctagggcagggcgcggcaacttttctttaaagggccagataacaaatatcttaggctttgcaggtcatgcaacattcacaatctcaagggttcagtagaaaaaagctactagatgggcaaagaagcacaaataataagactcataactaggagaaaagtcagcaatagaaacagacccagaaacaacagagataacagaaatagcagacaaggattttacaactattataaaaatctcaaggatttaaagagaaaaactaataataagagaaactgaaactataaaaaataaatggaatttccagagctgaaaaatactttaatatcttacttatgtaaaaaactaattggatggatttcacagatttgacactgcagaagaaaaagcaatgaacttggagatatagcaatcagcaaactgaagcagagaaaaaaaggactgaaaaaaaagtgaatagagcctcagtgacctgtagcacagtatcaaacacaccaaaattgtgtaattagaatctagcgatggtaggcagaagaaacaactgaagaaataaatctgaaaagttttccaaatttggcaaaaactacaaaaccacagatccaagaagctcaataaatactaagcagaataaacacaaaggaaaccacaccaaggcacatcataatataatagttgaaagtccattataaggagatctgaaaggcattaagagaaaaaaaattacaggaatgcaagattagacttaacactgacttctcaacagaaacgatgcaagccagaaaactatgaaataatatgtttaatatgctgggaggaggagaagtaaacctagaattttacatacagtaaaaaaaattcttcaaaaatgaaggcaaaataaaacaatttttaagaacacaaaagctaagaaagtttgtcaagagcagacctgtcctataggaaatattaaaataagttctttaggctgaagggaaatgataccggctggaaactttgatctatacaaaggaataaatagcacttgcaattgtaaatatatgaggaaatatagaaaattttgggttttatattttttaattttttaaaagataactaagtaaagcaaaaatagtaataatgtatcatggggcttaaaacataaatgaaagtaaaatgtacaatcaaatagtacaaaagatataaggatagaagcatactgttgtaaagtttttgtattatacataaactggcctactatttgaaggtagactgtgatagatgaataataatacatatttttaaactatcagacatatgagaagatgtttgcagtcaaagatacacagtgtaaggcaatgaaatatcattttttacatgttagattgatagattgataattacagaagatttatagcattcactattagtgataatgtggcatgctagtggaagtatgaattactataatttggatagtaatgtggcataatccattaaagagaaaaagctcatatcctttgattcaacaagctacatgtgagattatgttacccacaaataaaagcaccatatatttgtacaagtatatgtgtaagaatatttttattttggtgaatatgctgcattttgggggagacaagggggcaggtgggaattagaaacctgaagacctgtaaataagagaatggttgactaaatcttagtacatgcatggtatggaatacttgtagctattgaaaaaaaaaatgaggccaggcacggtggctcatgcctgtaatcccagcacttttgggaggccgaggctctactaaaaatacaaaatacaaaaattagcagggtgtggtggcacatgcctgtagtcccagctacttgagagctgaggcaggagaatcatttgaacccaggaggcggaggctgcagtgagctgagatcgtgccactgcactccagcctgggcaacagagtgagactctgtctaaaaaaaaaaaaaaaaaaaaaaaaagagagagaggaaaaaagaaaaaaaatgagagcgctactacgtgcattatggaatgaagtttgtgtcatgtggtaaaaggaaaacgaaagatagatggatggacagatagggaaatagaatagctcaatttgtttaaacctagaatatattttctgtatggcttaaatataaaagaaaaacctaaaacgcttttatacgtctataaaggcatgaagaaaaatgtggaaagattctcgtaaaactattatttgggaaggagagactggaggggaaaggaaatattattaacatttgatactactctgcagtgtttgatttgtagaaaaggatacttaattgagattcttcctgcctctttagcagaggtcctacaggccaaaataaaaaaactaatgcattcaccactgaagacagtggtactttggaccagtgacttctggtgtgtcacatgcttctctgtttcctaagctgagcattcattgtccctgttccaccattttatatccttggagcggggcagggcgaggtgggaggtgcaggtaacctgggttttttacttgtttgtttataggctgtggacccagaggaggcatatctcactaggtagccaccactgctcatttttcagagagcttggatctcagctggatgccatgactggacaggactttgggttgtctcatttgggaaatcagagtattttctatgtatgagaagcatggaaaaaaaggacatttgaagccagaagagtggaatgtagaaaagaatcttaatgattatacatccacatttcagagtacttctcatagggcttctgttgatgtactctacaacaaaccaaaaacaaacaaacaacaacgacaacaaaaatgaggaacatatgtgtggttttatgtgggaatgtttgtgagaaatttgccttttatgcaaatcactctcctttttataagaacttgccaaagttttgcaccaccaaaagttctggctctgatgatcaggtaaccagccatgacatgatggaatctgtgaatcctgtaacatatgtttagatttagctgctaagaatagcagagccagtttgtgaataaagtttatgttgtgtaggaccctgcagctatcacagctttaaatttacctcatgtctcactttactctttaacctttatgttcatttaacaaggcatccagcaatctaaagacctctcaaaaacgcactgctgctctccaagacatggcaatttccatgtggtttgttcatcttttttttttttttttttggacagagtcttgctctgttgcccaggctggagtgcaatggtgccatcttggctcactgcaacctctgactcccgggttcaagccattctcctgcctcagcctcctgagtagctgggattacaggtgagtgccaccatgcctggctaagttttgtatgttcaacagagatgggatttctccattttggccaggctggtcttgaactcctgacctcaggtgatccacctgcttcagcctcccaaaatgctgagattatatgtatgagccactgagcctggccagtttgttcctctataaacaatgtttgtgcttgttaaatgtcagttgtggagaaggtataagtctacattttaagaattatggagattattcataatctgagaatctggtattgcactattttaattttatataaactttttcaatacataacactacaaatatattcaggagttatgttgctgtcctataagtttaatactttggagagatgagtaaaactaacaaagtaataacttttagaaatgaaacttttacaaaatgaagcagttaaggttgaacagttaatcttagattctgagttttctcattataagtaaaagtttaaaatgatgttaaaaccgtcttaccaagtttaacgagtgccagcattcatttgatgccctaaatgactatgttagcaaccacctcctagtatttatcctgacaagtgacactttaggaaaagcacatctcagttattcatagaatagtgtgattacgtattttcagggtgtttggtatcagcaatgaaccaaattagacatttaaagtaatggaactataccagaaatggaaactgaactagtatttcctagaaaagactttgtcactgtcactgtggttatccacttaattgagcttttgatttacaagtacattcatttacctaacagctacacagaagaccatatcatacccatagacttaaaaatgattacattaacaatcacagttgacattttgggttgtatattaggctcttgcttcatcaggcatcgtctaccatctagggtttattctttagaaagcacagaagcaagtttgtctttgttgttatttttgttttcattgttatttttgtttttgtttttttctctaactagacaggcaaccactgacaaaagccatgcctgtattagtgaaactcccagatattaataggaggagaaggcagaaaaaagaagtggggaaatagaaaggcctctacagatggtgatttcatacagaaaggttaccgacttgctaagaaaaattatatttaattttccaactaatttttaactgtcgaaaagtgtgaagattgaacaacacctacaatcccgttgaactggccaa

SEQ ID NO: 20 - DNA, 20001 bp, Homo sapiens
acttggtatttaattatgatagaataatttcaagctagaggaaaattaactgttttactcattaaggctaaatatcaattatttttatgtcacacctagggaaagttaagcttcttcacgctcatctatctgctttttggaggccattgtattaaccctgtagacaagaagctaacctacttccaaaactcttgcagcacataatcaaagaacaagcaattggataatgagtaggaactgcctttcaaagtgaaagctacagagaggtggttaaacaattattatgaaagcacacaggtaagctttgaaatattccttttcctgatattttttagacttagataattattcaaccttttctcaggccactccccaccaaaatatatcattgcatgcatttataattttgacttttactgagatgtcatattatggcaaatgactttctcataagtgctattatcgaaaataaaactaatcttgttcttattcctctctctctctttctctctctcttcctccctctttcctgatagaatttatgacaccaagtggtcaaagaatgccttaagctgcagtttttcttaagctctatgaccttgttagtaaaatgatatttgatgtattgctttaaaaatatcaaaagatgattctcccccatttttatatgagtataaggtaagttcatcccataatgggaaaatcaattagtagtggcactttttgactagagagacttaaaataaaattttgaggaggtttaattcatagagcgattaatcacttcaaacatgtcttaattctgtgcttcttacaattgttcatttcatagtgctacctataatttaatatttcattggtcaatgttgcacaagcagacaggccttatgtactgatttgtgtatgtgtgccttttatcttttagaaagtaaatcctaataaatacacatagagtatgtcttagagttcctactttccccctctccctcccaacttttttttttttttttttcctgtaatgagaatggcaggaaaggatatccagggtatcaaaggcaatttttgaaaacaaaactccacttaagacatttttattttgacatcgcaaaagaaaaaaagttattaaaaatcaggcttttgtgtttctgccttggaaggcaaaaaaaaaaaaaaaaaaaaaaaaaaaaacacagtgtccaaatgaaagtgaattatcctatgcaattattaaatccattaaagaaaataaaaccaagaccaaaaattataaatggtgatttactctgagcaatcaactgagaaataaacagatttttaagaaagccaaatattttaggcaaataacatgaaatatatttcaatctttatttttattttaaaaaatagatttcatactcttgctttctacttgtgtcatatcgaaatatgaaagtgatcatcaaaaatagctgttaataaattggttcttgaagattagatttttaaaatgcccaacagcttattaatgtgacatttctaccacatatttaagccgtggtgtatctaaaaataatttttaaatatgcatatataccctaatttgaaactttctcagccaatatctatgaaagaaaatcatttctcttattttaaaggaaacattctaaaatcacaatcaagtaaataaattttaatcctcttgctaaattgctggttagtacacaatggataacttttttctttgttctaatttctttcccccacccaataaagctgtcttcttttttctgctactaactcctccaactacctaaccagctacttaattctgaaactaaactttttcttaaaattaagaagaaggggaaaaagctcctgtgcctcattaaaacgtcaggcctcttttctgactcggctcataattgtatcttttaaaccataactcaaccttaatgtatactgcttgacacccgcgtgttgggagcttaagaaaatgccgtctatgtacctttaagaccacaagctcactcatgctgcctggcttcctgccaaacttggaggcaaaagcaggagggtttttgcaaaatatcctctaacaattgtcgctccctctttcaacactaccttcaccatcattccctttgaaaacaaatctgcagaatggtcatctgcgctctcagcccatctcatcattcctggggaagccgcctctgccacccctcctccgccccctcagcccctcgcccctctgcttcccggggaggcctggcttgcttgggtttcaaaggttcagcccactccgcaccagggtccctgggcacctttgagcccttcggggctccctggccgggtcagaggaaattcagccctttttctcgccactcagcaccctgcagtcttaattcacaaggcccgagttcccttggagggacgcgcgcgcgtcgagccctcatccccacgcggcggtgcaagcgcatgaatggacactggaaggccgtgcaagtttggtctgagccgcccccgctggcttttagagttagagtcccagcccacctgcggtggagcaactagcttcttgactgccctgaattttgtgacatagagccccccgtggcccaaaatcaagaaacttacttgttttgtcatggagtcaatgaggcgcacgtagaaatcctgctccgtccttatccctagggttggaaatgggggaagggaggagaattaagtgagaggttacggagggtgggtggacaataattaacaacaacaaaaaataacaacaaaacccccacacacatatcacgaaaggggctccaaggctgattggaactcccactgtcctggaaaatacagccacgatctcccttccccagtgtccagagaggtgctgctggccttgccttagcgctcctggaagccagacgccaagttctgcagctgggactgggatgggggtaccccgacttgtctgttctcacggcaagagtccctctgctctcgcacacagccttcaaggccatgacccttcagcccctaagcccaaggggccatgggcctgcagcctgggccaagccaaaggaacaggcctcaggaaggggaggaagaatgaaagtggctcagggagggatgaggcactacacctggccccaggtaaacgcgagaccgataaggctcttgggccactaggagcctcctcaggtgaaacctcctggggcgaaatttaggagaggctggttcacctcaaataaagcggatgactgaccttcgctggaggatttcgtccacctggagctccctgcgccccctgcccagacccggagccccagggtgaggccatagacccgacccgggcctcaccattgctgtagagaagctgaagccggtagtgaattccgttattggtcttttcgctgttggcttcctgggttgcatcaggacgcaaagacacaagagatgcaggagagaggtctgcgtgagcgagtggaccaactttcgaggcaactttccccaagccgggacccccgctggcgagccaggcagccacggtagcagcagaaattgtggccaattgtgatccctcctccgccccctgttcctgactgctccctctctcccaaaagaaaattccgtcgggcgcacacaggctatcctctttccagggcctaggggctcgtgccccggccaccagaggcaggcggtgcgtaatctggtagtggagggcgggttcattccgggtgcccatggctgtggattgtagagccaggcttgcctctctctagctctgggggctccgtgcgaacttttctggagaaggagccagtggaccaggaccctgggttcgtctgggatgggaagtggcttgggggacccccacatagaagtgtgttatggatgctttgcactcaaggaagggcgcgctgcccaaggctcccgggcctgctcccgagccgagccggggacgaggggcgacagcgctgcgcccacttactttttccttctccacgaaccccacaaacgctgtcctctcgatctccacgggctggccctgtctgtcgtagagggccaggacgaagtggaagaagttggatttccgcagattggaaggcggctgcttctcaaagtgagcccgggccagacccaccccgctgcggccaaagacgcagagttagatggctaaaccggacgccgacccgcgccccttgtcaccctgtacacacactcgaaccctcaaacacccacctcctcttcccccaaaacatccagtgggcgctcttcacgccccttcaggcgacatagacccagctgacaacgggacacacatgtcccctcatgtcctcgtcctctccgccaaggacgggtgcgtcctcagaactcgctgaagaggtgtgaaagttttgtttgggttttgcgcgcgagatgaaactctataagcatttactcctacctgacacgcactgcgtggggaggaagaaaagtggcggtggatgaagtgaacccaccttcgcggagtagaacccacagttatattccggcacccctcgaatctcacgtctcagctagcagggcaggtgggaatggatggaaaacatgctcggcgtctcgccgcagcagccaccctccaggaacccctcaagctctggccaactgcgagtgcccggccttgggaagccacatccccccaccaccaaaaagcatgtggagaagggtccgagggcggggctcagaactgtcgcgggtggtcgctgtgaaaaagggaagaggggtgttttcttaaagacctgtcctaacaaagtttcgctgttccgcagaaatcctcacactcattccagaaatcctaaaggccagggctgctggctcagtgcgccggccggcgatgggaggctggagcgcctggggcgccaggcggccactgacagccggacctgcccaacacaagcgcgcacaggcacacacacacacatagaagaacacacacgagcgccccgcgcacacactttcacttccagcccagttacccaattcactctcactaccacccacccccatcctaatactcagtggggatgggaacagtgttggggacacttgtccccagcccagggaagctggagatgatgtaattagtcatcttccttcttccccttccgcactctgagtccgatagggcctggggccaccagatctcccactgtcccaagctcagctggtggcttaatggggggaaaaaggccatttctcacttgggaccaggagcctgggaaagagccttgggtgtgcccaggaaagttccctcaggtcaacctccaagggcaatgcctccaggccacacagtctagtgtctagggagctgcgagtgagagaagggctggaaggggccatggtgacaggggctggagaagacttttgggagatatcagaattaaagttgggagttgctattctaccggtagactaagaaaaaactgaaagacagagagggagggaaggagaacgagatagcagaaataagagaagactcaggggagaaatgggacgaaaaaacaggaaagccagagaggtaaggaaaggagaaagaggagaaaggagggaagctgaagaaagaagagaaagaaaatggagagaggaagggaggaaggaaaagagtgagggagaaattaagggaaggtgggggaaagaaatgagagaaggaaatgaaagaaagaagaaagaaaagaaggcaggaagagagacaggaaagaacgaagaacgaaagaaatggaaggagggaagaggggaagaaaggaagaggaaggagaagagaagaaaataaaggggggagaaaggaaagaaggaagaaagaaaaaagaaaggcaggaagaggaaagagaaagaaaaaggaaaaagaaaaggaggaaagaaaaaaagaaagaaaaagaaaaaagaaagaaaaaggaaggaaggaagagaaagaaagaaagaaaaaagaaaagagggaaaggaagagcgaagggaaagaagaaaagagagccggccggaaaagaaagagcaatcacataaaaacataaaacacagatctccaacatgctgtgttgagacgcctcttctgggttaaaacaaaatgaaaacagtcacagacgaggcaggggaaagtgctggcaaagcgtgggctcctcgcagacagctccaggtcctccggccgcaggcgacgaaggcagagcggctggagagcgcggagccccggcggagagcggagcgcagcggctgcggactcaccccgccgcccggccccgcggcagcagctgccgctgccgctgccgcctccgcctcccggctctcccgctcgcggctcacctcggccgcggtccccgcgcagtacccacctctgcgccgccgtgttggcgtccagcaccccggcgccctgcatccacgtccgcaccgcgttcatgccgctgcccagcggctcttccttcatgctgcttccactccgttggatgctttcctgaatcccaaacatgaaaacaaccttttcttgtggaaaatctcctcccccttgaaaaaaattaaaaaaaaaaaaaaaggaaagaaaagaaagaaaagaaaagaaacaaaaacgccaaccagagatttttttttttctcagacgatgaactcgcacttagaagatcaaggcgggctggaaagcaaatttttaaaaaatgtaaacctctgctcaaaactgagcgataacccgaaaaaaagaagaaagggaaaatccaacgaaaagaccaaaataataaaattagagatgtatgcttggctgttgggggttgtttggttggttgatttttggtttgggtgctttttttttttttttgcttttttttttttttttttgtaatgatcacaggccggtggaggacaggaggggctggagtttccttttgtagaggtacccttcacttgaagaagcaggaagaaaaaaaaaaaaaaaaaaaaaaaaaaaaaaaaaaaaccctgatggcaatttaagaaacaatagactcaactcgcgctgccggctttgctacttcaagtgtcattttccacaaccaggcaagttttttcctctctctctctttttttttcctccttctctcccaaccaaagatgtttctttcctttgcgtgtagatgaggaggacgctggttgccgtagacagatacaccagagagggtggggggaaggggagagagggagagaggaaagggggggagggaaagagagatagagaggagagggagaaagagagaggggtggaccctgctggatggagattctgttttctccttgctaaaatagaagtgatttgcaggctttccctatggaatccagtttgactttccccagagctaaacacaggcacactaaccccaaagggaggaggcggggcccgcgcatcgaggccccgccccttcatttgcataacgtcatctttccgcccaccgcagccaatcgcggcccgggagccggctcgctggcggcgccaggccacgctctctcattaacatcccgctcccggtggcgcaggggagccggccaaagttcctcgcaaagtggcgagcgaaggagcgctgagcactgacgtctgggctggggaggagcgggtccgagcgaggacggagaggggacagagggaaagggaggcgggtgtcttcctcaggaatttgagctggggatctgcatcctggccattgcagtcctttagcatcctcgccgcgccctgagcgcgctggaggctcgcaggctgcgccctcccagggctgatgccgcgtcctgctccgccgttctgggacgtcggggacaaaagtggaggagacgggagagcccgggcagaaaaagcaggacgcgcgtcccaggtgcccacctcttcgctttgaggcgggggcggtgggatggaatatgggtgcgcgaggtcggggctggtaactctcggaggggcacggcctccacgctgggagggatgaatggacgctgggccccggcaaatgaggcgctgtgggtccccaggaagtggggtaccaggctctactcccaccccggcctctgaaacgcttctctctcggccgctagcctagaggctgccagggttgggcactgttctcactcacacgctcacctctctcgggcagtcctcgagatatgtgaatggtggaatgaatgctctcactggggctgtgtcaggatgcgtttttaaattttctcaaattaaatgccaacccctcattccccaccccaagtagttggttcgtttgtttttagagtaactaccaaagcaacagcaatgttaaccgtccttgattagctggttatttggtgtagggtttttctcatcctcctttattcttcctgttaaaaaggagggcttgaacaaatccttcctaactctgtctctgccatatgaaaagggtggggggagaagagaaggaaggtggggagaaaggacaaaaaaggaagaaggggaagagaaaatgggaaggaaggagggagagagaaaggagagaaggagaaggaacgaatggaaatgggagagatggaaggaaaaagggaaagaaaaaaggacgaaattgtctccctcctcaggcttttcagcatgtatctttgtggctggcaaaggaaatagctagaagtttctgggtaatgtaccccatcattttttagcaggttgtaacctctaataagcacatggtgaacttctgtttcattgccctcaaaggaactccctgactgcagccaaatctgctaaggactccttcggggaaattatctgccagaaatccaggtcccctttctgctggccttccttggtcctttgatttaggaagctcatggggtcagtgatggaaaagtacacatgcccatgttgaatagagacaggcaagagttatgctttgtgctcttggcagagcagtggagccacttcctgattcctaaactggatgaaagagtgtggtcctggcctgcagtgcatggccactgtcctcaaacactgctttatctcctgtgcacgaggcctgcccagctctcacacatgtaatctagacttcttgtgtgctgagcactttcccctggtaccataattaatgccatctcttccaggacttccctgaagggattggtctgatcttttgggatccccatagcattcacaggggttcctaacatagcgttcatgtcgaagaagagtataatggtggagagacttgaagggctgtaggtttttggggataggtatgtgaacattttcagtctctatagtatttaaatgcacaattgaaacttggcctgctaaaaactttctaaagctccaaacttaaccttatgctccaggtccaaaggggtccccagagtcaatccctccccctgcctgggccatattctccagctcagagaggatccttgaaggtaaggagatgaggaagcaaagcccacccatcctatcaatgggtcccatatagccctggcaaaaggcctaggcctccttctctttatctgcctgaacctccattttactctccagtaaacagtcctcaactgcaggactcccagctgagtctggtggggtgtctccagtggtgagggacacaaaataagggagcagatcactgccaaaggaaggtgacaaaagtgccagggaaaagaaaagcatagacaccctcaagtccaggatcagcaagagacacacagcagatagatttctggggttgaacagagtctagaagcatctgcaaaggatgcgtttgttgagagcctgaagctgactcacccaaatgagaaagtggcacaaagcaagaagtcctgagcagctcaatttctaccccagagccagtctctccaggaactaaatatgagggaggcaatttccatacctgccaggctagagaaggaagaaaaataaaagggggcagaaatattttgataagactaatttcctttggctgtgcagaggcagcacatacctcacctggggtggtgagtgtgctttattttaatcaagccgagtgtattcatagcttttcttcttggtgtccttgtgctttcagtctggctttctcatcctgtaataaatgtttaagtaggaaggaggctaaagagaaggtggaagagagacagagtgagtgacagaaaactggaaatgacacacaggccagcagagcagtagttttttttatggattttctctggtgaatattgaaccagcaattgtaattttaaactttgaaaaagagcctcttaaatacttctaaatcttcatgtgagggtagcactacctccagagacaaagcatgtgtgtagagggtgattgccatcatacctgaaagcagatacttcaagcactatccatcacaattaccttaggtatatactttatggtaaaggtatcctgtaatgagatattctagtatgtacagcattgcctaggctttatggcatatgagtgatttgactttagggtagtttataatagtaatccccaaactgggttcatcaggctaatcacatggggaagggtgcaggcacttgttagaaatgcagatttccaggccttatcctgacccacagaatcagaacctcctgtgttggtgcctgggatctgtatttaaagttatttggaaactcttgatttttgaatatatatcatctctgagagaaagaaggaagggaaggaaggcgtgaggaaaaaagacttttgcatggggaaaaaatacagcagaatgagtttacacctggaaagaaaaactagagaggtttggggtttcccctggagcctagtttccctgatgagctcctcaaaatttctgcagctgtgggagttcaggatacacagcccctcagatgctcccagcggtaggcagggctgtccagctctcgggatctcttgacctgggcctggaggaagcccagggcagtgtgcaagcactccctacccacccactcccaccctgaccttctgctccttggctatcccaaccctcttgaggcacagggaaatcaattcccctttctgaaaggcaacatctaccagtaatttctggggactccagtagaaacataccggtctccccaaagagaagagactagataaatacagccaaactaagacccgtggaaaggtcccagcggaagagggaatcgtctctgttcgtccgcccccaggaggccagacttgggacctgtcacttggaaaattctcttgatctccattccccttgtgagggcgggcccacagaagggcaaaccgtcccgggacgtgcccccttccctcgccacctgccagggacagcttcgaacgaggcgggaggacagatgcctacttcagtgttgggaagggaaaggggaaaagaaagatgcaaggacctaagccaaggcgcaaagtccctcagattgcggccgctccagaggagtcgaccagcagcctggagtcggggttgaggtggagaggagcaggggccacggcgttgcccggtggacgagaataggagtgggtggcggcccggggacctgggaaagccgggacctgcgcgaaggctcggctctgcggggcccctgaactgcacccggaagatggcgcgagtggccgaacaccgtgacacaccgccagccctcaaaaccgtggctcttttcctcggtgatctccatgcgcagtcctcggggaacgcgtgggagtagcaggccaggggtccactggaaatccagaatctgatttctgtttccgattccctacgctccagagaaggcctcctctgctggcccagtatgaccgacacttcccggctctgggagcgcacctccacctcccaccccccatggtacatacagggaaactgaggcctagagaaggacaaagacacccacagacggctaggagatagagaccaagcaaacaacaccgcggggctccgtcccaggttgggagcgcttagtctgatacggccagaagcctggggcaaggggttcctacaggtctttctggggcgagcctgccaactctcttgggtttccccccgggcggccccagataataatagatcccatttgttgatggctttacgggcaggaactcactgaatatccgccacagaccacggcagataagaccactccggcgttttacaggtgagcaaacagagaccctgtgagcgaagttgaaaaacttgtccacggccaacagctaataaagtcgccaagccagaatatcgctaaagcctgtccccttaaatatagagccaaaccgtccacccagctgtggcgcgaatctcttgtcccccaactctcaagtgtcctttggctctggagctcctgggcccgggttccgcatccgggaggagaaaggagcgagcgcgcacggtgcctcccgagggcagggagcagaggagaggaaaggggaagactatgaaacgtcctaactaatgcgcgtactgaatgcgcattcacgtggtcagttaccgatgtgcttctctctctcctggcccgcagggacagagcgcgccagggacgtgccagccccggccccggctctgccacatttactatgtgacctcctgtcagtcattctctctcccagtcctagatgagatcttagagctcacgcaagcttgcctgttggaacagactaagtatctgactttgcggggatgttcctgatgcccatcgaaggacagaaatctggacacttgcggatgtgctttaatgggggagatgctgattctgccctggcgtgaccatagatagctagaagctgaagtcattctgagtcgggagaatacagttgggggcactgccggaaaggatctttaagtccgaggatgccctagggcgtgatcatatcccacccggtggcccttgcccacagtcccctagtccacgagattggaatccgatctgggaaggtccctgctcccttggtagaaggaggctctgggatgggagaagggagcttcttagcgatttgaaaattagcatcccttcagtagcgcaaaccttatggaagaaaccttggccttaaaacattctcagaggggagactgggaggaacaggcctgtttattcaggggaaagttggagaagggagggcgagtttagcagaaaagctcgagatgcctggataacaaaaagtttgcgctcatacttccttcgagggacaatttgctgaatatttacacacctttgcgtgctgcgaggtctttgttggctactgggatgcgagatgtgtatgatgtgaatgtgcaaatatgtttgcatgtgcgaaaagtggctgcacatttgtgggccagtgcagtaagtgtgtgtttgtgccggtgacagagagcacttggctgaatgtgtgcgtgggtgcgtaaggcattggtgcacacgggcgtgagtgcgcatgtgtatagtgtgtgcacgtgtcatgtgtagtgtctaagtgagtgggctgtgcatttgcaaaagtccgtgtgtattgtgcaagagcatcgtaaacgtgtgtgagcctgaactcacacgtggttttgtgtgcacgtgtgcgtatgaaattcagcaaaaaaaaaaaaaaaaaatccaaaaaaatctaggtctaggcagggtgcggaccgagggcccaagggcaggcgtgcagaccgctacgactttggctttagggagacgccttcggggcgcagggcccgcccgaagacgcgggttagcatacagctcagctccaggcaggcgatgcgggttcccaatgcgggcctacagattacgcggactgagctgggaacggtccctgctggacagttccgtgctcttaatccttcctcgcctacggtctctgattattgatgcttgccgtgtgtcctaaaagggaccgcttccggtttatttgcttatgtatttattatctttatcaacgttattttttggcagctgccgtgaagatgccaaacccaccaagactgcgctgccccacctctccgaggctgtcctgggagtgcgggtgacccgcgagctccagaatctttccttaaggtggagccacagcgccacctcgcgatcctccagcttccctccctcatggccacggaaggctggccctttctggtccaagcccccagggtcccacacttactggttttccatgcactttcattatttccctttctctctcttcaatgttcccttatcctgagtattgaggtccccaaacgcgcctttctaccccacgtttggacatagccggaatgtctacctccttctccatccggtgaagcactgctccccctaaaatcaccagctcaaaagtcacctctatgaaacctttttagacttttccaacgcagtcattcgtgcctttccctggtttccctactgctcgcatcacattggacaggaaatgctatttaaacgtttttctcctctccctaatcagggagctcctctgagaggagccatggctgtccttgcttattcaacaataaaacctagtatatatcaagtgcatactatggagcgtttaatgcactgtactgtgcaaaaacatattgtcttatttcattttcccagcaaaatcatgaggaaagcacgaatattgtttcccattttgcagatgaagaaactgaggttagagaaaataagtacccatccaaggtagcattgcagagcctcatccaagtcagcctgtcggatgccagagccaacttttcttaacctctgacttgcagacttattcagctgtatatccgtgggctttgtgataggaaaagacacagaatgagtacttgtgtgtttatgaataaatgtatcttttaaattatttcttctcctagagagttgggtgtgggaaggcactgcaattatcagatactttgattgaaatgtcaccacaattatttatctctaaagagtattcctctgctaagtagctaggagaccttggtcaagtcacttcatcctcagtttcctaagttctaaaagtaggttttctgtggaggattaaatgagaaaaaaaaatgtgaattacatgatatatagcattctagtcattgctcagtaattataataactcgaaactactgaaacacacacaaaaaaaacaaaacacaaaattgacttaccctagtcacacagaattccctgtacctctgtatgaaatcatcttactgttatatcttcattttcatcttagacatgaattatataataaatatttttagtttatggtggttagggtgttaatgttaaccctgctctgttacaaatatttaaggggtagtgggagagatataatcaaacagtaaaccagcaaactttgcctcttgtaatttcctcctgctttgtagatctttaccaagaaagatttaaagaaaggctataaaagtacttattggccaggcacggtgtctcactcctgtaatcccagcactttgggagtccgaggcaggtggataacctgaggtcaggagttcgagaccagcctggccaatatggtgaaaccctgtctctactaaaaatacaaaaaattagccgggcttggtgacgggtgcctgcaatcctagctacttgggaggctgaggcaggagaatcgcttgaacccaggaggcagaggttgcagtgagccaagatcgcaccattgcactccacctgggcaacaagaacaaaactctgcctcaaaaaaaaagaaaaaagaaaaagaaaaagatgcttattattctggaaagtacaaaactctattttttaatttaggggagattctgagctagtttaagtgtttccctacttgaaaacatcattgctaccaatacattaaaagtttaaaaatatgtgtctaagcaaatgattgtatccaaataaaagaaaactcaaataaaataatgtattactactaatatattaaaagtttaaaaatacatgtctaagcaaatgattgtatccaaataaaataaacaaatgaaggttgtctgaacatattctagaccttaagacatttcccaaaaaggttaagttttaaagatttaacatctctttctagagtgacccattaaacaaacattcctattgtcaattaggtgaaaatgaactttttcccctgttacggctataactttcctactgtccaattattttggaaagactgttgactagtattgtcatgtcataaacacatgatttctcctctgagaaatgaggctaataaaatccacaaaaggtataaacgtgcctccacattttgctggcccacagtccatttctagaaacttcactccagccccagtttaatttactttattgtacttgcttcccattctatgcaattctcttgtatagagatgaagaaatggattcaggaaactctataatgtgttaagatattttattgtacagctgatggatatttgggaatttgattcatattgatggtgtgagacactggcgttttgacaaagttggggtgtgttctgttttccttttttattcctattatggtggccattagagatgttcaccaaaattttgggttttcttcttccaggtgcatagaaggatggaagtattctgacccttctgcatttagctgtgatcttgtgatttgccctggcaaataatgaattagcagaagtgacatgtgtcacttacaggggcagaagcatgaagagccatagtgcaatttaccaaatccccttcccggtggcacagctgttgctgcccccaccagatggagtttccatcagcatcccacccctggcacagacgtgtggagtggagacatctcctacacccatagacatttagcaagaatgagaaataatcctttgttactgtaaatcccagagatttttctgtactgcagtataacctagcctctctggaagaatacacttagaaaggaaactcatcttttcttttcttttggggggcaatttgaaaattcttctcctagagtgaaaagtagactgccatgtctaattaaataaaataatcagaaaatgaaatcattcaactagaaatctgaatctcattttcttagtctattcatacatttccccagggtcaaaacatctggaaccctctgaaataaggagaataactaaattttacaaatacttaaaaggaatctcaaaattattgctagacctcgacaagaatattcagtgggtccttagtccacttgcagatacatcatgaagtgagttacataggttgtgattagaaaatactttattagcaattggccaggcacagtggctcacgcctgtaatcccagcactttgggaggctgaggtgtgaggatcatctgaggccaggagtttgagaccagcctggccaacatgacgaaaccctgtccctactaaaaatacaaaaattagctaggcgtggtggcacacgcctgtagtcccagctactcaggaggctgaggcaggagaatcacttgaacccagaaggcggaggttgcagtgagtcaagatcataccactacactccagcctgggtgacagagagacccatttcaaaaaaaaaaagaaaaaagaaaaaaagaaaaggctttattagcaactgtatgcagacataaagtaacttttctctctgcctcatgttcaattctatatcagattggcaaaaaggaaaaatatttgactaatcaacttgaatttaataacgtgatctagggcaagtcatttaaattttccagaccttcttgtcctcatgtggtgtgatggactcaatgtttctgccttgccccgctcctctgccctgccaaattcatatattgaaacccaaatgcacaatgtgatggtattacttcccacagataactaggaggtaattaggttaagatgagccatgagggtgggattagtgtccttaaaagaagaggtagagactaaagctagcaagcactctccatctgtctctctccctctctgtctctccctgtcatacgaggacacaacaagaaggtagctttctgcaaggcaggaagagaaccctcaccagaacctcatcatgttggcatcctgatctcacacttcccaacttccagaatggtgagaaataaatgttagttgcttaagccacctagtttgtggtattttgttatagctgtctgagctgactaagacaactagaaaataagagtagacaacatgaacttcagggtaccactcagttctactaagctagaattttgaggtatctgggtgatagcagtttcagagttgatgctacagtataaaaatcttcctgtgtctccatccccaacactattttgtgaatcttttttcatttttttatactgatctcaacttaaaacaactgcttcttaggcaaaataatacttctttccttaagcctcaaatcttttaaacgtgggaatctgctagaaaagtgtgctgtatagatttggggccatgtaaaatgctttgtcattttctagccaagaggagaaatttgcttctatattgaagagctattctctataggtttcattatctgataacctaaagagtttttctgtggattttcaggaaacttttgtgagaaaatattgactgtgcgatgagtgctatagggtgaaatcattactgtctattctttatccttggtgtggcatgattgactgccaagaataatattgttataataatttcatttggataataatttaaatttgacaaagaagtttcacatgagttactgccttgacttctcgtaacacaccatgcaactgacatttctgccccacttcacagaggaggaacaggtttagatccgcccatactgtatggttaagaagcaccagatttggggtgtaactcaaaagccacagctgcctatgaaatttagaaagctgtctgaagctttagtaggaaatagaaagtgtcggaactatgctatggagcacttttttataaaaagatgcaggatgctttctgttgcagacatgatcgctggtaacagatgcctggttcactctcatcctggccatacctgaggactatgctcctcttctagaagttcggtgcagtcatctgacttaattgattcagcgcatttatctgcaggtgagagaacccccagagcactcgttctcctcaaccagaaatattactgagggcagatccatcagtttgggtcctgctatgatgatcagtttgggtcctgatatccatacagatatccagccctggaaagtaaaaacaagcttcttttctgagcagttcatcatgtactgttttctttctgtgaacagaagattttaacactaagacgattttataggcagacacgtagaagaagctagcagaggtgtcttaaacccatttgtgcctatagagccatacagttaccccggcgtgaaaaatattaaccacctttttttttctgaacacttcatcatgtactgtttttgctcagtgaatggaagattttatcacaaagagaagtctgtaggcaaacatttagaagaaactggcagaagaagtttcttggaccatatatgcctacagggccatacagatgtccgtccctgaaaagcaaaaacaagtttcctttctgaacagtttatcatgtactgtttttgttcagtaaatggaatattttaacaccaagaggaatttgtaggcagacagaagaagcaccatgagctctttaccaatatgcaatggatttaatgtaagcaagtggtttaagccactcggatttctggcttgcttgttactgcagctgaacttagcttgtcttcactggcacagtttcctaattcaaatttaaatcttttgtaaaagagaactatctctgtagggtagacactcttatacttcagccatagacacatatctctcaaggagaaagtattcttctagacctctcatgtttttatttaaattaattttattatgtaacttaaatatgtgcaagcataaaactagagatcaattcttcatgcataacaatgcttaaacaatggtgaaactaaattgcaaactaaatgaaaaagaaaaaccccacaaaaccaaagatttataagtaaacaataataaaatatactggatgacattgttttgtggaaac

SEQ ID NO: 21 - DNA, 201 bp, Homo sapiens
ggaaagttttcggagttttacagcaagaaaaacaccattatgtttgatgacatagggagaaattttctaatgaacccacagaatggactaaaggtaagacrtacttttacttgttatgtgctcatgtaatctgggctgtgtggtagaacttttgtagtaagcactgttgaatttcatatatttttggaagtactgtattct

SEQ ID NO: 22 - DNA, 201 bp, Homo sapiens
ttggatctaaatcacaaatattgggaaaggtaagttttaattgcttatttattttctctttacatcaatgaagaaaaaattatcatttttcatcagtgacyccagtatatatatagctgtcttaatttttatttaaaataggtgacttctaaaaacattttctaatccagtgacctacccccaaaagtattttcccctttc

SEQ ID NO: 23 - DNA, 201 bp, Homo sapiens
ctgtgtgcccagcacttcctctgcatgcctcagatgcatttgacaatctcaggtgaactgcacttcagggtcaagggaaccccggccatggttctaagaarcaactcccattttagtatcacctacatttgaaaccacagagcactgtccaggagaggtgatggtggtgggtctcctcctttggctctctggcccatcagc

SEQ ID NO: 24 - DNA, 201 bp, Homo sapiens
ataagggactgtagctcgtcatttgatgtagtaggatatgtaatgatttagaaattttcatgacacatttaagtgaaagaagtattttagagaacactgtygtaagccgttagaaaatagttcttaacctttgtttggttcaggattacccttaatttaacaaagaacctgtcaactctctgaggctgctcttgtttataa

SEQ ID NO: 25 - DNA, 201 bp, Homo sapiens
gcctaggctggtctcgaggtcctgcactcaagcgatccacctatctcggcctctcaaagtgcaggattacaggcatgagccactgcgcccagcccagaaakagttctaaaatggagaaatatcctcaaatgctgtgttttgttatcatgctttcataatgcacttggtagaaatctcaaagatttcatgtagatcttaaaa

SEQ ID NO: 26 - DNA, 201 bp, Homo sapiens
atcatattatctaaaattaatttaaaattattgaaagactatcttgagttgtataaagatatttgagcaggtgtcttttacaaaacagcagaattctttaytgaagctataaaataaggaaaagtgcataaatttatagttcaacaaactgtaaagataattcttgtaaaaaattttattccactaaaattactcatgatt

SEQ ID NO: 27 - DNA, 201 bp, Homo sapiens
taaactctttttcatcataaaatagatcagccttaaacatttggaaaatatggcagttctttttatggaaaactcttgcataattaaaaatgattttaacrgagaatttaatgataaagaaaaatgcttatgataaaatgtaggaggaaacaggttatataaatgtataatgatatctcagctatataaaaatttaataga

SEQ ID NO: 28 - DNA, 201 bp, Homo sapiens
tggaatataatccctcttctcatactgtaacttaatgtcaggataagataaaacacatgtaaaaatttcataaatagtattaaaaattaccagtaacttgwgtgtagcagagaaattagaaaagtttatcctactaaaaaaacaattactcataattttcctttttaaagataaccactgttaccatcttggtatatagtc

SEQ ID NO: 29 - DNA, 201 bp, Homo sapiens
caaaggcccccttccatttctcctctccagagtgttccagtaagaacatccccttctagctatttcacacatggacaaccaagaaatagtcatttacagarcattttgcatttgtacaatttcactcgttatttctcccccagtacctaatgggggctgcagcgtgtactctgttcgtggttaaattctgctgccagaagt

SEQ ID NO: 30 - DNA, 201 bp, Homo sapiens
aggggctacaggccccatgcaattctaaaatccagcagagcagtcaaatcttaaagctccagaatgatctccttcaactccatgtctcacattcaggtcaygctgaagtaggtgcccgaggtcttgggcagctctgcccctgtgactttgcaaggtacagcctctctcccggctgccttcacaatctggcattgagtgtct

SEQ ID NO: 31 - DNA, 201 bp, Homo sapiens
ataaaaactaaagataacatcttgacatatgtccctgagttatttttcagaaacgcagactcccaccagatggaaaatgttacataggctgtcacacagaytgaactctgactgccattccttgttctaattttcttcctgaggggcctgaagaaagtcatgcacacagtccaaacctgaacattcctttctgtggacccc

SEQ ID NO: 32 - DNA, 201 bp, Homo sapiens
gaacagatgaccaggggtgactcaggacagagcaggtgaccaggggaacagatgtgaactgctgattagaactggtggaaaaagttgtttactgaaactaygggcgaggagaatgaggaagttaaactttaaaatggagaacaaagaactgaacatactgacatactgattctttgaagagaaatttagaactcactgtat

SEQ ID NO: 33 - DNA, 201 bp, Homo sapiens
ccacttccaacattggggatcaaatttcaacatgagatttggagggacaaatatgcaaaccatatcaggtgttgatggtgaaggggtgctgtgtttctttytggggtattgaaaatattccagaatttattgtggtgatgggagcacaactctgtaagtgtataaaacctgttgaattagacaccttaaaagagtcacttg

SEQ ID NO: 34 - DNA, 201 bp, Homo sapiens
gtgataatgtctgggcttggcaattaccttcagtctgttctcctcctgtgatacagttaatttttcctaattaatgagattcctggggaggaaactcatgrcaattgagtgcctttttggaagatctatctttaggcagacgaggcaagttcagagaccacccttccctgtgcttttgaaacaggggtgagagacagcagg

SEQ ID NO: 35 - DNA, 201 bp, Homo sapiens
accaaggccaggtaaaaaccaccccttcatcccctaaaccttgcaagaagcacagggtccagaattatgcttctttcaggttctaaatagcacaataaaaytaataacaataagcttttagttattagatcaggtacattttactttacagtaagcttttacttattggatcaggtacattttaaagcaatttttgaacat

SEQ ID NO: 36 - DNA, 201 bp, Homo sapiens
aattacttaaatatttaaatagcatgaaggcccatggcaacttgagagctggaaaatctatacataaattagctgattgtttcaatgagcatttagcatckaactatacaaatacagcaaagatatcattgtgatcctaaaaaaacgttttaaagcaaatcagatagaaattatctttttgggtctattccgttgtgtctt

SEQ ID NO: 37 - DNA, 201 bp, Homo sapiens
atcagatagaaattatctttttgggtctattccgttgtgtctttaaacattttgcttaatatcttccacttttcctccaaattttcatcctggatcagaayctggaagagaatgccaaaagttgatgtggggtgacattgtaacagcaatgtctcttcttatttctcacaacatatgatcctgggcaactgggtttcaggg

SEQ ID NO: 38 - DNA, 201 bp, Homo sapiens
ggaaaatgtcttaggttctctgtgtctgtttcctcacttataaatagggataacaataatgcctacttcatagaattatagttcaaggtaaaaatcacgtyaaactcttagcaagtctttagcacataggaagcactcaatatcacctattagtcatacagatcttaaatagggaaagtacttgccaagatgtaaaataat

SEQ ID NO: 39 - DNA, 201 bp, Homo sapiens
ggctttgtccagtgattttaaaagtggggtgaaaggagtctggggcggtacaaaagggcctctggaaccttgcaacaggcaaaggaattctgctgtaaggygaggaagctgggaagccaatatcttagcctctataagtgtagacattctgtttagtaaaataattttataatatctggaacagccaggagctatccattt

SEQ ID NO: 40 - DNA, 201 bp, Homo sapiens
cccctctgactctctctgcagagagtgtagcagctccgcacgtcaccccttgggggtcagaagagctgaagtcaaagacagaaattagcctgtgttacacmttggggagagagttcctagtgattgtagccagtaaggcaggtaaggcctcaactgttgtctgaggacacagtttctccaactgggctgatttctacccag

SEQ ID NO: 41 - DNA, 201 bp, Homo sapiens
gtctgcttcagggcccctaagatctacgccctggagctcttgtttttatttttgactcaaggtgcaatttcagcaagtcatttgtagctttgaattctccktttatccctttctttggtgctatgaggcttcaggaagcatggccaggcaatttggatgagtgggttcaaacacagcagagactattctcagttcccaata

SEQ ID NO: 42 - DNA, 201 bp, Homo sapiens
tatctgccttacatttgactgaggattaaatgaaaaaaaaaaaaagcacgtaaagtacttagcacagtgtctgccacacagtaaattcggtgttagttatygttacttatagactgaggagtcagccaactgtacagagaaactctcttaacaattttccatggatatttaaggatttcgttccctctgttttaaatcacc

SEQ ID NO: 43 - DNA, 201 bp, Homo sapiens
tcccatgatggtcaaggaataattttggaggagacgtttaactttaaaaaaaaaaatacaatcattagtttcatgtttgtttaaaagaaactttgttttcstaaccaacatttgagctccattcatctcttgatgcagggagagatgttattgtaaatgtctagttctttatgttactttacagtagggtttttaaaagac

SEQ ID NO: 44 - DNA, 201 bp, Homo sapiens
ttcatggagccatattttctggtcataattgtgtatcaggttcattcatgctaatgagaaagggattccagattttctttgcatctgtctgcttctcacakggctgttaagaagccacctgccattctgacaatttcatgtccttagccataactacttgtcctctctcttgaatcttaagatctttttgccttccagaca

SEQ ID NO: 45 - DNA, 201 bp, Homo sapiens
ggacagtagaggtgctttcctgtgggatccccaatctctccccgccttcaggtgagtcctgctgatgctcaggctgcccttggaacagggaccttggccayagtttccttatctgtaataatgggatgagaattcctcctgcacagggttgttagggacctcgtgaggcagcttctatggctgcctttggtgcttagtttt

SEQ ID NO: 46 - DNA, 201 bp, Homo sapiens
ttaatggttatgggccatgcattgaaggaccaccctgtctgtgctaatccctcactttgcactgaacatggaactaagctgagcctctccctggggatgaratgatagattttctatttactgccctttcttttgtcttttcatagcttttggtgcggacatgtcttggagcagttacagtcaattgtctctatgctcaat

SEQ ID NO: 47 - DNA, 201 bp, Homo sapiens
gctcatttgctgttgagcagtgggagcaacttgttggccaagttactcgctgagcctcagtctctttgtctataaaatggacctaatacttatctcaaagrcttgttgggaaaggcaatgagataacatattatagaaggcaaccaataacatattaacttgaacctagaggaagaggtaagggaacaattcggtatctgt

SEQ ID NO: 48 - DNA, 201 bp, Homo sapiens
gagaaacttccagcacaatttcagtttcatagagaatacggcagggcacaatattcagcagagtaacatagtggttaaaagctcagggtgtcgagaacaaygaaccaagactgtcatcctgtctccactaaccagctgggggatttggaacaaggtatttcattatcatgagcctcagtttcctcatctgtaaaatgataa

SEQ ID NO: 49 - DNA, 201 bp, Homo sapiens
ctcacctaactgcagggcacagatgcccattcgctccaagatgagctatagtagcggtcctgggcccgcacgctaatgctggcatttttgcggcagatgamcgtggctgaggtcttgtccgtgaagactctatctttctgcaaaagagaaggaaagctgtgaagaccccttggcaacatagtcacagggtaagctgagcct

SEQ ID NO: 50 - DNA, 201 bp, Homo sapiens
cctgggcccgcacgctaatgctggcatttttgcggcagatgaccgtggctgaggtcttgtccgtgaagactctatctttctgcaaaagagaaggaaagctrtgaagaccccttggcaacatagtcacagggtaagctgagcctgtttctgcaatgcatactctcccaaaacaagcccatcttggtcttagggcactgtgct

SEQ ID NO: 51 - DNA, 201 bp, Homo sapiens
taaaaatctggttagtgttgttcattaaatgtccgttaagtactttggtaactgcagatgaaagaccctgtagggggacaaacacttgttattaacaaccrtatgctgtcaagtgtgggcttataacacgggaccatatgctccaaaggttggcaaagaatgacagaagccacccaccattcctccaggccaggagcagag

SEQ ID NO: 52 - DNA, 201 bp, Homo sapiens
gtagtggctagatttacaataaaaaggacagtcctggagactatctttaaagaagaaaaactctgcattgcatgcactgaaattaatcgaatgctaagagrtcatgtcgcaaaagcactgggcatggtgggagccagaacatctcacctctgccccaggctggccagaaatttggggaaaggtcccagttctcagtgctta

SEQ ID NO: 53 - DNA, 201 bp, Homo sapiens
gcaatgctcaactgtttcagtcaaataccttaaaaatgagcattcctgggttgggtgacggaatattgacaaattacagctttgtcagaactgctactaastctaggcggaccttgctatgtactttattcccttataaagtttgtgagtggcagagacaggcctagaagtcaagccttcttggacactgctcagtgctgt

SEQ ID NO: 54 - DNA, 201 bp, Homo sapiens
tgtgtgctggagcacccagaactgaaggacttgggttagggacaggaacggtaatacagaggcgaactttcaggttctggcaacgacctggtcaccagccmttgctgtaggggtttagcttctcttgttttccaagttcaaagactactctctcccatatagagaacctagtggttctaaaatttgagtgactgtcaggat

SEQ ID NO: 55 - DNA, 201 bp, Homo sapiens
gttcaaagactactctctcccatatagagaacctagtggttctaaaatttgagtgactgtcaggataacctggaagcactgctacaacagacggctgagtmccacccccagagtgtctgattcagcaggcatgagggcctgagaatatgcatttctagaaagtttccaggggaagcagatgctgctggcgctaagaccaca

SEQ ID NO: 56 - DNA, 201 bp, Homo sapiens
aatgaacagaaaatggaagtgaggtacagagacagcttggttggttacagctaggtgtttgctttatttgagcatggtctgatcagttggtaacctataaytgattggaggtttgctgctgtgttttactgctgaggctcagctattagctacaaaaatatattaaattagctttcagtcagttcataccaagttaggttg

SEQ ID NO: 57 - DNA, 201 bp, Homo sapiens
ctgtatgcccagcaaagggctggtggctggaaggacatagctttctgagttaggactggaaggcttctgtacatgtccaaagtcaaccttcatattcatgrggagggaaaaagaagtgggctttaggattgcctctccttgttggcctgctctgagaaaaacaatcgcgggagggtgaggcgggagaatcgcttgagccca

SEQ ID NO: 58 - DNA, 201 bp, Homo sapiens
ctcttatttttaagatgagaaacttaaagcttagagaaggaatgtgactttctggatcaacatctagcagttgtttatttagtgcttactacataaagagmactgggctagaagcagttgagagagaaaaaaagggcttacctggatcccgcttcctaggagcaaatacttttactcaataaatatttattaagtcagtgt

SEQ ID NO: 59 - DNA, 201 bp, Homo sapiens
ggattacacaaatgtgtgaacagcagaaggtagaaacattgagggttatggtacagtctgtttgccacaatccctgaatccattctttaaaaagttggtakaaaaatacctactttagagggttgttatgtgaattcaaaacaagataacatatatcgagtgtttacgtggtacctggcacatagtgagcattcaataaat

SEQ ID NO: 60 - DNA, 201 bp, Homo sapiens
tactacaggggagaacactggtggacagacacaacctaaacaaagtgatcaaagttaatttcaccagtactgagagacattgatttcatgcccctcctgaygagattcactgagaagggcacagtattactgctgtaggatgcttgacaaaaatgtagaacccaaatttaatcatgaagaaacatgagacaaatgtcactt

SEQ ID NO: 61 - DNA, 201 bp, Homo sapiens
ccgatagtgcccacggtgaacccgtattattgttcctctatcaggtagctcaatatatatgaaaagatagtggaatctgctaggtgatacaggtgagggargatcctttgatttgagttgatgacaggaattcagctgagtcatgttttaggatgcaggctcatacctagaaccatcttgaaagtaccatctgggagcaag

SEQ ID NO: 62 - DNA, 201 bp, Homo sapiens
gacttttcaggaatctagaggtaaatcaattatttaattgaatacaaatccctcttacttttattcccagttcttaattctctggagcactgattgctatyacttcttgttggataatctgtgaggagaactgctgtagcttcctaaataaggcttttgaaagagccagtggtttgtcagaaaaacatgtgactaaaatcc

SEQ ID NO: 63 - DNA, 201 bp, Homo sapiens
atagcttttcattttttaactggggccaaagttagttaatccacaagaatggggatcccagctgtcattttggttgatatcacaactgacgaccaagaccrtcacaaatatgggagcaagtctgatttgtaacattattataattatgaatccaattactttaaggaatgcacgaaaggctttttaaaaatttcaatagta

SEQ ID NO: 64 - DNA, 201 bp, Homo sapiens
acagacctagttagaccatagtccatatttcaaatataattacatgtgctcatagctgagaaccttctcctgggatggatgcatttcaccaggtcactgcygaaatgttgtacttttatggatggtgatgaggaagcatctgttttaggtgtggtatttcctggaggcagaaaactgcttgagttagctcattcagttttt

SEQ ID NO: 65 - DNA, 201 bp, Homo sapiens
aaaacatatgggttgggttatccacttcaatgactgcacattaagcaagagtatagtgtaccatgttttatttaaccattcctctgctgattatgtctttwtgcacttggagaaacatttctttagtaagcattttccttttaaagatgaaaaagtgagaccccaatgcttaatttactcagtgaaataatggtaaagtca

SEQ ID NO: 66 - DNA, 206 bp, Homo sapiens
gtgattcagatctgggatggggctcaggaacctgcattttaacaatggaggttctaatgtggtcattggcaggttgttctaatgtgggggccacattagagttagacctctctcggagacaggctgtacatggccagccagcattctggtaatatgagccaaatgcccattgacctaattttggagaagaggtttatcaacatgtc

SEQ ID NO: 67 - DNA, 201 bp, Homo sapiens
gtttacaatgaggatattttagggaaagaatactaatctaggtagtgaattgccataagtataaaaactgttgacttggaagaaaagtggttatgttgtcyttaatggtttctgtttaaggcttggagagaagtgcttttcttaatatgtactgcaccaggtaaaggtacaaaaatgtattcttgagtcttgagaagaaat

SEQ ID NO: 68 - DNA, 201 bp, Homo sapiens
cgaaatcagttattggactaatgatacctatagcagctcttcagtgtaaaaggtaaggaatggaaaaacaggttgttacagtaagcaactgaaacttattytttattcatggaaagtaaaatagttccttgagaggaagaggaactacaggatagggactgggaaaaaaggatatgcaaaaaaacgcagattagttgcatt

SEQ ID NO: 69 - DNA, 201 bp, Homo sapiens
ccatatcaggtgttgatggtgaaggggtgctgtgtttctttttggggtattgaaaatattccagaatttattgtggtgatgggagcacaactctgtaagtstataaaacctgttgaattagacaccttaaaagagtcacttgtagagtatgtgaactatacctcattacagctgttagaaaaatgtataccttggtggtca

SEQ ID NO: 70 - DNA, 201 bp, Homo sapiens
aatatctgattgtgttacttccttgctgaaaacccttcagtgggtttcagggcccggggcccccagaacaagattctgagtcctgcaagcttgcaagtcckccatgctctgcctcctggctacctctctcttttctttgcctttctctttaggaggccagaaccccggtctgttttctttcctgcaatatccctgtggcca

SEQ ID NO: 71 - DNA, 201 bp, Homo sapiens
tggaggttaacatcaattaacatcaataagagacttgatgttaattcattacactcaccatgacttggcttttcaatttgttgttgttgttgtttttaacycttatgagcgaaagagaaaattgatactatccaagggtatagaattacctttctggtcctttaaaatatcagtggaccaaattccatcttcctttttgtg

SEQ ID NO: 72 - DNA, 201 bp, Homo sapiens
tgaagcagtccagtagagcttagtcttcccatttaatgaagaagcgtactgaggccaacgatctaagcatggtcacagcaagtcagaagtacaagggctayagctcagaccttttgtctcttgggctttgcaagggatgcctaatgctagtgtctaaactggcctttgaggaatggcttagtatagtatttcagagtgtgt

SEQ ID NO: 73 - DNA, 201 bp, Homo sapiens
tcacaagtctgttatgtaaccatagttgggactggagtctgctcctctgattcccagtcctaagatctttggcttagacatttagtacattttgtagtggstagatttacaataaaaaggacagtcctggagactatctttaaagaagaaaaactctgcattgcatgcactgaaattaatcgaatgctaagaggtcatgtc

SEQ ID NO: 74 - DNA, 201 bp, Homo sapiens
ttatgtctttatgcacttggagaaacatttctttagtaagcattttccttttaaagatgaaaaagtgagaccccaatgcttaatttactcagtgaaataawggtaaagtcaggatgatcacctggggtttgcttcggtgatgattaaagtaagccacatgggggttaacacataggtcttgtatttatggaagttgctttc

SEQ ID NO: 75 - DNA, 201 bp, Homo sapiens
tctggcgaattctacgtgaaatgtcaggaaccagtgaagggtgttaagcatagaatgacaatctaattttttttaacagccttattgagatagaatttacmtatcacaaatttacccatttgaagtgtgcagttcaatggtttttagtgtatttagagagctgtacaaccatcactgtaagctaattttagaacctgattt

SEQ ID NO: 76 - DNA, 201 bp, Homo sapiens
tctggcaaagagaaggccacacaccaggaagcccctgagggtacagggacattactgattataaaggagggaaggaacaagctatgtgtgttcctgataamccctggccctcgggattggctgtcaaggggctcaaaacccagtccaagggacaaacacatcatccaagccttgcaatgcagtgatgtaagtgcaatgata

SEQ ID NO: 77 - DNA, 201 bp, Homo sapiens
ttagacaacagaggagacattggacttttattgggaatgatcgtctttgctgttatgttgtcaattctttctttgattgggatatttaacagatcattccraactgggtaggtttttgcagaatttctgttttctgatttagactacatgtatatgtatcaccaaaatttagtcatttcagttgtttactagaaaaatctg

SEQ ID NO: 78 - DNA, 201 bp, Homo sapiens
aactcctggactcaagaactctgcccaccttggcctcccaaagtgctgggcttacaggcaggagccaccatgcctggcctatgattatgctttttcttgargtcatcatcttctatattagtttcctattactactgtcacaaatcatcacaaacttgaaagcttaaaacaacatgaatttattatcttatagttctggag

SEQ ID NO: 79 - DNA, 201 bp, Homo sapiens
gactagaaattgaggctatacctgcaatgggagcaatgtacctgcctttgtcccaactcaggggaaaaattcaagctgctttatcacaatgcaaacttcgygggggagaaagggtttctttctataattcttgtattcaagaaggattcattgaactactgaatgtccttactgttatatgtgcaaggccatttgaaggat

SEQ ID NO: 80 - DNA, 201 bp, Homo sapiens
aattgaacccaggccaccactgtgaaagtaaaaaactttagctactgagctacagtactgggtagtctccattgtgcttcccagaagggctctaaagtacktaattttgagcttgcaaaagcttttaactactcaacttaatttttagagctaactgtgacatgaaccctaaaattcctgttcccttgaaggcagagacca

SEQ ID NO: 81 - DNA, 201 bp, Homo sapiens
tattattatctctattttccaaaagagaaaacctgagactcagcaagttcataattatgccccaaggtcacagagctgataagaggcagagtttaattcamacccaggtatatcaggccacgctcttggtcattctgctctactgcttagacccctttgccgagcactgtgttgacctgagggctgtctatcctcttccag

SEQ ID NO: 82 - DNA, 201 bp, Homo sapiens
gtgcaacagtcagaattctacttggagccaaacattaagtacgtatttcaagtgagatgtcaagaaacaggcaaaaggtactggcagccttggagttcacygttttttcataaaacacctgaaacaggtgagtgtacttatatattttattctgttgggcttttctttatatatcttttctgctgagcacagtggctcaca

SEQ ID NO: 83 - DNA, 201 bp, Homo sapiens
gtgcaatctcggctcactgcaacctccatctcctgggttcaagtgattctcatgcctcagcctcccaagtagctaggaatacaggcacacaccaccatttscaactaatttttatatttttggtggagacgggatttcaccatgttggccaggctgctcttgagctcttggcctcaagtgatctgcctgtctttgcctccc

SEQ ID NO: 84 - DNA, 201 bp, Homo sapiens
ttgagtatttctaagctgctcgatagattagagttgtttggtgtggcagttccccagtgtgtccagttgctcacaaattttgacttgaatgttctttgccraattggcactgagtttctccttcttgccatcatttgcttcatgaaataatctttctttcgtttacatttataatcaagtgcagtagaaagattttaaatg

SEQ ID NO: 85 - DNA, 201 bp, Homo sapiens
gcaagaccctgtctcaggaaaaaaaaaaaaaagaggaaaaagaagaaaaagaaaaagaaacatgaagaaaggtaagggcactctgaattatcaatcaattrcaagccaagtgcttaggttcagtacagttccctaattatagatgcctacacagacctacctacaccttgatatttctgtgggatcagtggaggttaggaa

SEQ ID NO: 86 - DNA, 201 bp, Homo sapiens; identical to SEQ ID NO: 11

SEQ ID NO: 87 - DNA, 201 bp, Homo sapiens
aaaatccattgctgtagaggtcagacacactctttaagagaaggaagtgtcatcataaaagacaacatagggaatggacagaaaatgtggacagaaaggcrgagtggatatgattgcccaagccattgaaacgggagagttccctgactcctgtcgcatatcatgtggctcatctattctgccaaggcacatgctcaaacc

SEQ ID NO: 88 - DNA, 201 bp, Homo sapiens
cagcctaaattttagggctttattatataacattctctttttaaatatgcggtagttacggtcaccttggaaagttctacaaaatatcccttaagtttttygaactttcccacatgggaatcttctggttatgagagtttgctctatttaatatgtgtacggtttcactgctagggtggttctcccacttatcttgaatct

SEQ ID NO: 89 - DNA, 201 bp, Homo sapiens
actctataactgcctagcaagattatgcaaattgataactaccatttatcatttacgaagtactcctgtgtataagcttgtttgattatgatgtcagccayatttggtagtgtaattagcgctactttacaaaagcggaaactgggcatgacttactaaatagtacattgctggtgggtaatgacacctaaactataacaa

SEQ ID NO: 90 - DNA, 201 bp, Homo sapiens
aatcagtatgattgtaaccagctttagacattgttacagcaattgggaattctcacctgtgtcagacaagccaaatgaagctcaccactaagaatttataygaaatttgcatgcacaagccgaccacatttgccagagatgcacttctaaaaacccactgacatcagatacatgtagcccaactttctcaaacaaaaagtt

SEQ ID NO: 91 - DNA, 201 bp, Homo sapiens
acccactgacatcagatacatgtagcccaactttctcaaacaaaaagttgtttcctggggtagttgtgcactctggaaaaacagtcactctgtggcctaargtaaaggttaattttgcttccccccaccctttctcctttgagacctttgctttgagcagagtaaagagaatagtaattctggtatcaaatgaagactaat

SEQ ID NO: 92 - DNA, 201 bp, Homo sapiens
ggttgaagtatggtccactgggattggccaagactcagttactgttacaggcacatactcctaagtcaggttttcactcttgtctgcctgttaagttaggwtacagttcatccacagggattcaaatatagaggtatgaagtccttctcaggccatatttagtttgctttaacacttgaattccacccaaacaaatcagct

SEQ ID NO: 93 - DNA, 201 bp, Homo sapiens
atgacacatggaattctgggctaacagttgcttccatctctacagggcaccttacttctggtaagaaaatacaacttaggctttttgagtagtcttttagkaattgcccattttaacccatcatactgaaaaaatcacatcaggtgttaagtttctggacaataagatatgccttatgtcttccataggaaaataatagac

SEQ ID NO: 94 - DNA, 201 bp, Homo sapiens; identical to SEQ ID NO: 12

SEQ ID NO: 95 - DNA, 201 bp, Homo sapiens
tagaagtggctctgtttcaagctctggtaagcctattagctaactctttccccaacctcatgtcatctgaacaaagggtttctaggctaaaaataaaatamtttttaaaagttcaaaaacaactggtcaacagaatagagtctgagttctgtaacacaagacttctgtgatctgatccactcaccattccagctttactcc

SEQ ID NO: 96 - DNA, 201 bp, Homo sapiens
acattttttttcaatttcatggaaaagaggtttttcatttttccaaaaattgtaccaaggtaaagcaaagttctagttgatgcaggtgcattgtataggcrttagcaatactgccctcattatgcactcattagacagtagtgcaaccccaagaaaaggatggttagatatttctttatagcaatgcaagaacagcctaac

SEQ ID NO: 97 - DNA, 201 bp, Homo sapiens
attgaaaagaagcagagcaatagagatgagaggaaaatctgaaaagataatgacacaatttcccacttaattttcattaagtaagagatgaaaactttagmctcggcatcaggaagtttgatttctttaattaattttttttttgagtcagggtctcactctgttgcccagagtgagtgcagtggcatggtcacagctcac

SEQ ID NO: 98 - DNA, 201 bp, Homo sapiens
ccttgaagtcacttctgtcagcttttaattatcaggaaggaggagactggcaaggctgcaccaggacccctttgagttcagactgaaagttaggtaccagkgttgctcaccccaccctggtcagaatcattcattagcagtttcctgacagcctttataactagaccaggctgccaggaaaagaaaagagcagagagaagt

SEQ ID NO: 99 - DNA, 201 bp, Homo sapiens
ctaaataaataaataaataaagtaaaataaagataaaagtcttaagcttcaggtagaaggaaataggaacaccacagtttaaatttaaggtctgtttcctraggagaaaaatcacttaagagacaaaaataccaattaaaattaagtatccctgaaaacttggatttattaaagtttaacatgttagctaagagaaaccat

SEQ ID NO: 100 - DNA, 201 bp, Homo sapiens
cagcactttgagaggccaaggcaggaagattgcttgagcctaggagtttgagactggcctgggcaacatagtgagaccctagtctgtacagaaaaataatmattattattagcctgggtggtagaatgcatttgtagtcgcagctacttgggaagctgaggtagtaggattgcgtgagcccgggagtttgatgctgcagtg

SEQ ID NO: 101 - DNA, 201 bp, Homo sapiens
atgtcaagaaacaggcaaaaggtactggcagccttggagttcactgttttttcataaaacacctgaaacaggtgagtgtacttatatattttattctgttrggcttttctttatatatcttttctgctgagcacagtggctcacacctataattccagcactttgagaggccaaggcaggaagattgcttgagcctaggag

SEQ ID NO: 102 - DNA, 201 bp, Homo sapiens
gtaatctatcacacatgaaaaaagcttttatcaagcttaaaggattacagcattgtttgatcttctgcaaatgtttccactgcagcgagtgcctccttttygccccctagagtgggaaggaagctgctttctcattctgtggtgtcttaacccacatcactattcagcacaaaggagacacttctgattctgtctttgcca

SEQ ID NO: 103 - DNA, 201 bp, Homo sapiens
actccagcctgggcaatagagcgagactccatctcaaaaaaagcagtgtgtgtttcagttttaatgtatttcagagacagtatttgattatgtacggccaygttttatataaagaacactttgttttcctagagtctagaagacagcttggaacataataggtgttccatacatttctgctaaataaaatagttgttttaa

SEQ ID NO: 104 - DNA, 201 bp, Homo sapiens
tgagcaaagcccctgtcttcatggagcttctattctagccagacagggcagaaaaacagcaaacaaaacaagaagaaaagtcaggtggtggtgaagtgtcrtaaagaaacatgaagtgggtaggcatggtggctcacattttgtaatcccagcactttgggaggccaaggcaggcagattgcttgagtccaggagtttgag

SEQ ID NO: 105 - DNA, 201 bp, Homo sapiens
tccttttcttctgtccttctctgccgagccattctgccattcttctgctcttctatttatctctctgtctgcttctggaacctggggtctggagtttatgwgggtacaggatagcggggcatagcaggccaaaaggcaacttttgagcacgaaaacaagaatgcctgcttctatttagggctatgggtttccaagcttgag

SEQ ID NO: 106 - DNA, 201 bp, Homo sapiens
tttgcaattctagaatcggacaacacctcatactataaaacagagtgagtgttctgatgagctgagcagaggaggttgatttaaggaactttcttatcacrctggcgaaaactggcctgtttagggatttggctgttatctctgtgtcctgatttgttgaaaggtcagataaagatcttagtttcagcaggttagtgtgga

SEQ ID NO: 107 - DNA, 201 bp, Homo sapiens
attccaatgtgataagtaatgcctcaactatcttctatatttgaaaatagggctttttcatgtaccagggagaaagcatgatgagcctggtgggtaatatrtgttgaataaattatattaattatttaaatattttaggagattaactcaactttgacatgcaagaaaagcattggttttgtttgtttgtttgtttgtttt

SEQ ID NO: 108 - DNA, 201 bp, Homo sapiens
cccttataaatatttaaatgtccaatcaggtagccaaatgtacctgaagctttgattgttttcccaggaatatgggtttgacaagccaaatattgtttatractattttagtagtttataagtcaccacacaaacatatttaatttggatcattttatcttttccattacaagtcgtaaaatgcagaacttttaataatga

SEQ ID NO: 109 - DNA, 201 bp, Homo sapiens
cttacctatcttgtgctaggacttgtctagacatcttcttcaatctttaaaacaacccatgagataagtgttacgcatctattttataatgaggaaactgmaacttagagtagttgaggaaacttttcaaggtcatagagctgctaagtgacagactaaaattcaaatccttttctttcaatgtcctggagtctattgtct

SEQ ID NO: 110 - DNA, 201 bp, Homo sapiens
aggtcatttccattttatccattatcaataaacttctttgcatagctttgtatataaatggtctttattcctttagttctaaagaagaattattgcatcargagttaagcaccttttaagatgctgatgtatgttgtcgaactgctttttaccgaatctttaatattgattgctttttaaaaagggacctatgaaaagaca

SEQ ID NO: 111 - DNA, 201 bp, Homo sapiens
taatcaagaatctttcagatgctcctaattgggctgaaaatagcagctgttttgaaactgcaaaaatgaatggtaccataactgtgaaataaaaatgaacyataactttaatgtacttaacatttatgtagaattttatctacctgtttgtggttgtcagcagtcttacctgaaccaattctctgtatgcagatttagcaa

SEQ ID NO: 112 - DNA, 201 bp, Homo sapiens
atatctttacttcatttcctttatccaatcctccattgatggagacagtcaggttaactccatgtctttgctattgtgcatagtgctctgataagcatatyagtgcaaatatctttttttatataattgtttctttccctttgggtttatacccagtagcaggattgctggatcaaatggtagtcctatttttagttcttt

SEQ ID NO: 113 - DNA, 201 bp, Homo sapiens
catcctgggccacacgcagcccaggagttggacaagcttagtctacaatttcaaagaagtaacttgctgaggtaacatatttactaggtaaggaaacaatytgtatcaagtctgattctaaagttaattttcctttctactaaccatgctgcctacctaagtggaatgaactagattgtgaaaacatggattcaagttaaa

SEQ ID NO: 114 - DNA, 201 bp, Homo sapiens
ggttactaacagcactgaacattatcaataagtatatgaaaacatttgcaattatttggtgaaatgttcacattctttgcccatttttctgctagaatacrtatcctactgcctgatcgaaatagtaatccttagtcacatgattgcatttttctaatatgtcccttgtcttaatattttaaataactttattctcttata

SEQ ID NO: 115 - DNA, 201 bp, Homo sapiens
gaatgtatgtgacatgatatttgcatttagccctttccaaatattccataattataaaatgctttgtatgaataagcttttacattatgacatccttgtayaaactacttggaacacatttcctaatattctcttaggctaggaattactgaatcagaaaaaaacatttttaaagactttgacacactgtcaagactgccc

SEQ ID NO: 116 - DNA, 201 bp, Homo sapiens
atttatgaagattttccctttaacaattatttcattaatagaaaagttgtttcatgaactattagtatcatctcttaattgtcctctaacttgagaattasgacgcttttcctttccttttttaattcccagtacactgaattgaattcatcacaatccttgattgacgatgtactgtcatcatttgtctgtgcatgtccc

SEQ ID NO: 117 - DNA, 201 bp, Homo sapiens
gctttctaccaacagatgtgcagggtatttttccctctgcccttgtttgttcattaatccatggtaggggacaccaatggatggtcacagttatgattccycccatcaatgtgttttgcttggttttcatagcatttttaattatttatttttggagacagagtctcattctgtcacccaggctggagtacagtggcgtga

SEQ ID NO: 118 - DNA, 201 bp, Homo sapiens
agcttgaagagactaagagcaggcaatccaagtctcctccacatgtggaaaccaagtccagagacggagcagtaactgcccggctcccacggcttgtaatygcagaaacaagctttaagccggctgcctccttcctcgttgcttttaccattatttaatttgtaggcttcacaaaggctatatgtgttgaaattggctaaa

SEQ ID NO: 119 - DNA, 201 bp, Homo sapiens
agtaggactataatcagaaggaaaaagcaggatttgacttataggtattcaattctttattatttttgtcttcattacaatagctaacacatatggaacaytgtctgcctggtactaaactcatttaaatctcacagaactctatgaggaaagcacagctttcattattagctccgttttacagaaagtaacgcaattatc

SEQ ID NO: 120 - DNA, 201 bp, Homo sapiens
ataaaaagacacacagtcctctccttccctttcagactagtttcctctttactgcagactgcgacgcaaggccatccactaatctttgatgcctgctcacygcacaggccccttcctctctccccgcacctcctcccacaacgcctgcagatctcagatgcgtttgaactacagtaaccccaacccagctcgcggcaagca

SEQ ID NO: 121 - DNA, 201 bp, Homo sapiens
gccaaaaatactattgacacaaacatgcatcacaactcactctacagcattaaccaaacaatccataacaaactaagttgacaatggcaaagctgttagtktttaaattatacacagtaatttgtaattaaaaagcaagaccagtggcatttaaaaatgatgacctaggccaggtgtagtagtgcacacctataatcccag

SEQ ID NO: 122 - DNA, 201 bp, Homo sapiens
gtccaccccctgacaatgatgatgttgttaatgactttgatattgaagatgaagtagttgaagtagaaaataggtaagtgcttttcgctttagaagtaatsagttgtcatgtgagaacaagtgaatattttatctaattatatgttttccattagggaagaaaacctactgaaaatttctcgcagagtgaaagagtacaaa

SEQ ID NO: 123 - DNA, 201 bp, Homo sapiens; identical to SEQ ID NO: 21

SEQ ID NO: 124 - DNA, 201 bp, Homo sapiens; identical to SEQ ID NO: 22

SEQ ID NO: 125 - DNA, 201 bp, Homo sapiens
gagaagtatgtaaacagctaactatattttgttaaagatttataggaacattttcacatgacaaagaagttcccaaccactgtggaccctcactggtgccsagatgtctgtggttattggtcatctcttgatctcaactccctccttgtccccttacccttacacaaaaagagcctaaaatttgtcttgacttaagatggt

SEQ ID NO: 126 - DNA, 201 bp, Homo sapiens
tgtaaccacattttggattatttcaaggtccaatgtgatacaaaagttggagaaattgaaaataaattttataaaaattataatgaagaaatatacagcawagaagaataaaagggaaacaataaagggttaaaagtacagattccagagctgtccagttcagcagccactagccacatgtggctattgagcatttgaaat

SEQ ID NO: 127 - DNA, 201 bp, Homo sapiens
acaacttgaaaacagaagcaatgcaccttcagaattgatcctgcctcccaagaagcctacttccaaagatcagaatcataaaatgcatttttgctgtcttygtaagcaattttgatattttgtcagtttcattgctattaagtgatcattccttgcttcaaatgaaagctagagagaattacaattcttatgatactgttt

SEQ ID NO: 128 - DNA, 201 bp, Homo sapiens
cttcccgaggtatggaaggattgtgaatctactcagtcaatcttaaaaggggcaatggggagagggaaaacaaggaaccctcacaggctaatttttaaacyacatctcttaagaaaatatggagaagcaaagagaggaaaatgtaaattacctgaaattctaccactgtaaatatgttgatatactttcagactttttcct

SEQ ID NO: 129 - DNA, 201 bp, Homo sapiens
cctccagagttatatacaaattgtaatcattcattgatatgtattgttacaagcgtaatatgtacagctggccctctggatccacaggttccaaaactacrgattcaaccaacctcgggtttgaagtattaggggaaaaacccaaagataataagacaacaataaaaaataatggaagtaaaagcaatacagtataccaac

SEQ ID NO: 130 - DNA, 201 bp, Homo sapiens
taaataaaatatcacatctattatatttacatgcattaataatagcttattgggaatattattatgggaaagtcatgaggataaaaaagttatagtttagwttcaccatgtttaaaatcataataatacggctgggcgtggtggctcatgcttgtaatcccagaactttgggaaggccaaggcgggtggatcacgaggtca

SEQ ID NO: 131 - DNA, 201 bp, Homo sapiens
ctgggattacaggcatgagccaccacgcccagccaagtaggccatcttttgatccatgtttcagctaaccaagcaaataaattattagaacctttttttawctccctgatctgcaacattaaatgcagaatccctgcttagtgggtccatatcagtaaattcagcctgatccaactttatgttctttccaccattatccca

SEQ ID NO: 132 - DNA, 201 bp, Homo sapiens
aggtgaggaggactgaccttgttaaaacacagattcctaggtcccttctctccaccccaattacatttctaccaaattaccaagtgaggtcaatgctgttsgttagcccagggaccatgctttgaaaaccactagtctagaagagcaatcacttgtccagggtcacctggaactcagatgatttcactccaaactctgcac

SEQ ID NO: 133 - DNA, 201 bp, Homo sapiens
cttgttaaaacacagattcctaggtcccttctctccaccccaattacatttctaccaaattaccaagtgaggtcaatgctgttcgttagcccagggaccaygctttgaaaaccactagtctagaagagcaatcacttgtccagggtcacctggaactcagatgatttcactccaaactctgcactactacgcatcacaata

SEQ ID NO: 134 - DNA, 201 bp, Homo sapiens
  misc_feature (101)..(101): n is a, c, g, or t
atttgtccatttgaagatattatgatttatactacactgttgtattatagttttaattgtggtaaaattgtcagtctagcaatcaatgaaaaataaaaccngcaccgtgaatgtgttattaactgtataagtatagtagtagcacaaatgatcaaatttaatatggtaaatctgcccaggaaacatacataacgaattatt

SEQ ID NO: 135 - DNA, 201 bp, Homo sapiens; identical to SEQ ID NO: 24

SEQ ID NO: 136 - DNA, 201 bp, Homo sapiens; identical to SEQ ID NO: 25

SEQ ID NO: 137 - DNA, 201 bp, Homo sapiens; identical to SEQ ID NO: 26

SEQ ID NO: 138 - DNA, 201 bp, Homo sapiens; identical to SEQ ID NO: 27

SEQ ID NO: 139 - DNA, 201 bp, Homo sapiens; identical to SEQ ID NO: 28

SEQ ID NO: 140 - DNA, 201 bp, Homo sapiens; identical to SEQ ID NO: 29

SEQ ID NO: 141 - DNA, 201 bp, Homo sapiens; identical to SEQ ID NO: 43

SEQ ID NO: 142 - DNA, 201 bp, Homo sapiens; identical to SEQ ID NO: 120

SEQ ID NO: 143 - DNA, 201 bp, Homo sapiens
agggaattgtggggtcagagcccccatacagagtccctactggggcactgcctagtggagctgagagaagagggccaccaccctccaggccccagaatggsagatctgacaacagcttgtactgtgtgcctggaaaatccacagacactcaatgccagcccgtgaaagcagctgggagggagggtttaccttgcaaagcca

SEQ ID NO: 144 - DNA, 201 bp, Homo sapiens
attcccaaagtgttacttttactgctatactttaaaatttcttcatttgccactttttaggtttgtggtcccgggcaagtttaatttcttttcaggattcycatttgtataatgaggacaacagctgttggttcaggattgtgaagcttcaatgagataattgtttagcatgtttttattccatcatgaacaccatttgta

SEQ ID NO: 145 - DNA, 201 bp, Homo sapiens; identical to SEQ ID NO: 59

SEQ ID NO: 146 - DNA, 201 bp, Homo sapiens; identical to SEQ ID NO: 61

SEQ ID NO: 147 - DNA, 201 bp, Homo sapiens; identical to SEQ ID NO: 62

SEQ ID NO: 148 - DNA, 201 bp, Homo sapiens
taaattgaaacattatgtggcctttcgtgtgggttctttaacttaggatagtgttttcaagtttcatccatattgtagcaagtatcagcacttcattccaytttatggctggatgacattccaatgtatgggtctgccatattttgttcatgccatttatccactcatggatatgtagcttgtttccactttctgcccatt

SEQ ID NO: 149 - DNA, 201 bp, Homo sapiens
tctggagccaggagttagaatccctgagttcatcgttttctttcatcactttgtccagcaaacttaggagcaaccaaacaactttatgacattccttgatyctccacatatggtcaaaggtattatgtatagagtcactaaactccttgcctctgcagagcagtgaatcaggagtatcaaatgcatttattttgcataact

SEQ ID NO: 150 - DNA, 201 bp, Homo sapiens; identical to SEQ ID NO: 67

SEQ ID NO: 151 - DNA, 201 bp, Homo sapiens; identical to SEQ ID NO: 68

SEQ ID NO: 152 - DNA, 201 bp, Homo sapiens; identical to SEQ ID NO: 75

SEQ ID NO: 153 - DNA, 201 bp, Homo sapiens; identical to SEQ ID NO: 23

SEQ ID NO: 154 - DNA, 201 bp, Homo sapiens
tggacagatgaaggctggtactcatgcttcttcccactgcaagaagaggagccatgtgtcatttcctctctgtgactgtgagcagcccttggcccctggarctccccaggtacaaccggaacaacatcatggtgcactgggcttacttttaagcctagaacatgaagagagctggttagaaggggacaagcaaaggactgg

SEQ ID NO: 155 - DNA, 201 bp, Homo sapiens
tcaaagcagaaccttaggctctaagggaaacaagacagaaggattctgctgacaagacagtaaagtagcctgctcatctggtggtaggcactgtgtcagcrttctaggttgtaaatgtaggaagtaagcagatcagaggtttgctcaacaacctgcctagtgagccaaactgcttgctcttgaggccatgtagtccttctg

SEQ ID NO: 156 - DNA, 201 bp, Homo sapiens
cctgaccttgtgatcctcccgcctcggcctcccaaagtgctgggattacaggcatgaggcaccgcgccaggcctattgtctctttaatacctctctatcayttgttgatctctcttcttaaggagggcaagcactcttcagccttagaggcattagcaggcaacagcatctattctagtggatctcatccttggctgcatg

SEQ ID NO: 157 - DNA, 201 bp, Homo sapiens
tcctgtcttctttaggcccagtttcctcaacaatgaaatgggactaattatcccaggtcacacttctctctgggcttaccctgggaatcagatgattgagstttggtaagtattatttgataaacaagtatgaggaaggaaataaaagggagatcagtgctgcagagatggctaattggcagatttacacagaactggatt

SEQ ID NO: 158 - DNA, 201 bp, Homo sapiens
cttctttattttctcaacaatgttttgcagttctcagcatataactttcatttcttttgttcaatttattcctaagtatttaatactttttggtgctattkcagatgaattttcctattaattttcatattggtcattgcaattgtataaaaatacaattatttttgtatattgatcttgtttcatgcaatcttgctgtga

SEQ ID NO: 159 - DNA, 201 bp, Homo sapiens
atgaggtgccctgtggggttaaacagaaatgagagatgcaaagagtgtaaggtggcatttccatttctggtctctgagctctacctttatgcactgttttrgctgttcagtctttatctaaataacttctaataactccactgccaccgccatctagctatgctcttgggtaatttgagttgaatttttgtcacatgcaac

SEQ ID NO: 160 - DNA, 201 bp, Homo sapiens
ggggttaaacagaaatgagagatgcaaagagtgtaaggtggcatttccatttctggtctctgagctctacctttatgcactgttttagctgttcagtcttyatctaaataacttctaataactccactgccaccgccatctagctatgctcttgggtaatttgagttgaatttttgtcacatgcaactgagagtcctgact

SEQ ID NO: 161 - DNA, 201 bp, Homo sapiens; identical to SEQ ID NO: 32

SEQ ID NO: 162 - DNA, 201 bp, Homo sapiens; identical to SEQ ID NO: 33

SEQ ID NO: 163 - DNA, 201 bp, Homo sapiens; identical to SEQ ID NO: 34

SEQ ID NO: 164 - DNA, 201 bp, Homo sapiens; identical to SEQ ID NO: 35

SEQ ID NO: 165 - DNA, 201 bp, Homo sapiens; identical to SEQ ID NO: 36

SEQ ID NO: 166 - DNA, 201 bp, Homo sapiens; identical to SEQ ID NO: 37

SEQ ID NO: 167 - DNA, 201 bp, Homo sapiens; identical to SEQ ID NO: 38

SEQ ID NO: 168 - DNA, 201 bp, Homo sapiens; identical to SEQ ID NO: 39

SEQ ID NO: 169 - DNA, 201 bp, Homo sapiens; identical to SEQ ID NO: 40

SEQ ID NO: 170 - DNA, 201 bp, Homo sapiens; identical to SEQ ID NO: 41

SEQ ID NO: 171 - DNA, 201 bp, Homo sapiens; identical to SEQ ID NO: 42

SEQ ID NO: 172 - DNA, 201 bp, Homo sapiens; identical to SEQ ID NO: 44

SEQ ID NO: 173 - DNA, 201 bp, Homo sapiens
gaagtcccaccaagactcccaaggatagcgtgttagcatacaagctgaatagcctgtgttgcagtccctgctagtcagggtcttctggataatgcattgcmtgtgtgaggactggcctggtcctctgcaggctgaattctgcatttagcagctcagtgtcccttccacgggccccagtttcttcatcaggaaggtgagggg

SEQ ID NO: 174 - DNA, 201 bp, Homo sapiens
gcttgtcccaaatttctttctatttgaacttccttggtgataaaaattctcctgtgggagaatttttgttgtgaacattttggacattttgttgtgtttgsctctagctaaaacatgagcatttgttcctagaagggataacatttttacacttctgttgccattagtatgtgagcaagaattaatatatgaactcattgt

SEQ ID NO: 175 - DNA, 201 bp, Homo sapiens
ggagagcaggagcaggagctggggtgattgcctttggaagccattaggaacaaactgtgtaccagcctgtggcagtgtctaggggttgtccatgacctctrgagcccaagggggcatgtgttacaaacaatactcttttagcatttgctgtccacagacagctaagtgtttacccgctcagtggagggttggggtgacagc

SEQ ID NO: 176 - DNA, 201 bp, Homo sapiens; identical to SEQ ID NO: 45

SEQ ID NO: 177 - DNA, 201 bp, Homo sapiens; identical to SEQ ID NO: 46

SEQ ID NO: 178 - DNA, 201 bp, Homo sapiens; identical to SEQ ID NO: 47

SEQ ID NO: 179 - DNA, 201 bp, Homo sapiens; identical to SEQ ID NO: 48

SEQ ID NO: 180 - DNA, 201 bp, Homo sapiens; identical to SEQ ID NO: 49

SEQ ID NO: 181 - DNA, 201 bp, Homo sapiens
aacaaggggcttcttgagaggaaatgaaaggagacggagatgcggttttgccttaaggtttttaatgtgagccactgagaagattcattttgaaatagaargatgtgtctgacagtgtgatgtaaatgcaggcattttggagtccctgctggagaacacacagaggtgagtaggggttctccagtgaccttgtgggagtct

SEQ ID NO: 182 - DNA, 201 bp, Homo sapiens; identical to SEQ ID NO: 50

SEQ ID NO: 183 - DNA, 201 bp, Homo sapiens; identical to SEQ ID NO: 51

SEQ ID NO: 184 - DNA, 201 bp, Homo sapiens; identical to SEQ ID NO: 52

SEQ ID NO: 185 - DNA, 201 bp, Homo sapiens; identical to SEQ ID NO: 53

SEQ ID NO: 186 - DNA, 201 bp, Homo sapiens; identical to SEQ ID NO: 54

SEQ ID NO: 187 - DNA, 201 bp, Homo sapiens; identical to SEQ ID NO: 55

SEQ ID NO: 188 - DNA, 201 bp, Homo sapiens; identical to SEQ ID NO: 56

SEQ ID NO: 189 - DNA, 201 bp, Homo sapiens
agttggattccccaaaataattagttagttaatttgttgactgattgattgacacattgctagctcctctcagactgcccagtcttcctcatgcccaaagkgctctcattctgttcatgataacgcccaaaatctttaccttggcacactcgtttctccatgatctgcccctactccctaatcgctgtcacctcctacaat

SEQ ID NO: 190 - DNA, 201 bp, Homo sapiens; identical to SEQ ID NO: 57

SEQ ID NO: 191 - DNA, 201 bp, Homo sapiens; identical to SEQ ID NO: 58

SEQ ID NO: 192 - DNA, 201 bp, Homo sapiens; identical to SEQ ID NO: 60

SEQ ID NO: 193 - DNA, 201 bp, Homo sapiens
taaataaaataaaataaagtagaaaagaaacaaaaattataagatagggacattaaatggagttagaaatgaggctaataaataatgaatatgctgcaccrtggaatactactcagccataaaacagaacaaaataatggactttgcagcaacttggatggagctggaagccattatcttaagtgaaataattcacaaatg

SEQ ID NO: 194 - DNA, 201 bp, Homo sapiens
cattctcatttaaatttgtatatccctgattatttttgaggccaggcaccttctcagtctatcagttatctgttaagttttgaatcgatttgtccattggytgtcttaccttattgattggtagaagcccttaattttggcatgagctctttattagttacatgtgtggcaaatattttctcccactcagggacttgctgt

SEQ ID NO: 195 - DNA, 201 bp, Homo sapiens; identical to SEQ ID NO: 63

SEQ ID NO: 196 - DNA, 201 bp, Homo sapiens; identical to SEQ ID NO: 64

SEQ ID NO: 197 - DNA, 201 bp, Homo sapiens; identical to SEQ ID NO: 65

SEQ ID NO: 198 - DNA, 206 bp, Homo sapiens; identical to SEQ ID NO: 66

SEQ ID NO: 199 - DNA, 201 bp, Homo sapiens; identical to SEQ ID NO: 69

SEQ ID NO: 200 - DNA, 201 bp, Homo sapiens; identical to SEQ ID NO: 70

SEQ ID NO: 201 - DNA, 201 bp, Homo sapiens; identical to SEQ ID NO: 71

SEQ ID NO: 202 - DNA, 201 bp, Homo sapiens; identical to SEQ ID NO: 72

SEQ ID NO: 203 - DNA, 201 bp, Homo sapiens; identical to SEQ ID NO: 73

SEQ ID NO: 204 - DNA, 201 bp, Homo sapiens; identical to SEQ ID NO: 74

SEQ ID NO: 205 - DNA, 201 bp, Homo sapiens
tacctcccaacagtcctgtgaatttactatgctaccccagggtgacctggtagagagtttggaaccacagctagccatagtactttcaaactactaaagtyagatatctctttgccaccaaatccctcctcagggccatatgtgaccctgcattttgtgcagggattccaggaagcaaagttgtcactctttctggaaact

SEQ ID NO: 206 - DNA, 201 bp, Homo sapiens
agtgacaattacatatcaggcacccagctaaattctgtgaatgtagtaagcagatcagacctggactctgtcctcatagagctaaatagatatgtgcagargacaaaatgctatgaaggaaatgaatgggtggtgagacagagaatcacaggggagggctctctgatgaggtggcatttaagttgggacctacaggtgaac

SEQ ID NO: 207 - DNA, 201 bp, Homo sapiens
cctgccagaaggcaattaaagagtggaagagcagaaatgcagagaaggaattcaacacctgctccaccagcacgttccttggtcgctctcgtctgtttccytagctggatcacattcttggtgaatgagagaaagtatgaggattaatgagcagacctgtctttgggataccctagaaccatgatgcaatgcaaatatcac

SEQ ID NO: 208 - DNA, 201 bp, Homo sapiens
ggatgagtctcacttagtcatgaaatgcagtctctttgtatgttgctggatttagtttgctagtactttgttgagaatttgtgcctccatattcttaagtrattttggtctgcagttttttttttgagatgtgtttgtctggttttgatatcagggtaatactaatttcatagaataagttaagaagtgtttcctcctctt

SEQ ID NO: 209 - DNA, 201 bp, Homo sapiens; identical to SEQ ID NO: 23

SEQ ID NO: 210 - DNA, 201 bp, Homo sapiens; identical to SEQ ID NO: 154

SEQ ID NO: 211 - DNA, 201 bp, Homo sapiens; identical to SEQ ID NO: 155

SEQ ID NO: 212 - DNA, 201 bp, Homo sapiens; identical to SEQ ID NO: 156

SEQ ID NO: 213 - DNA, 201 bp, Homo sapiens; identical to SEQ ID NO: 157

SEQ ID NO: 214 - DNA, 201 bp, Homo sapiens; identical to SEQ ID NO: 158

SEQ ID NO: 215 - DNA, 201 bp, Homo sapiens; identical to SEQ ID NO: 159

SEQ ID NO: 216 - DNA, 201 bp, Homo sapiens; identical to SEQ ID NO: 160

SEQ ID NO: 217 - DNA, 201 bp, Homo sapiens
aaaaaacaaataattgcatcaaaaagtgggcaagagacatgaatagcgaattctcaaaagaaaatatacaaacagccaccaaacatatgaaaaaatgctcracatcactaattatcagggaactgcaaattaaaaccacaatgagataccaccttactcatgcaagaatggccataattaaaaagtcaaaaaataatagat

SEQ ID NO: 218 - DNA, 201 bp, Homo sapiens
cactaatatgagaacaatctctttaggactggaaaccacgaagtcaattgaattgaatgcaccacaacccagtgagttaaatctttgtggaaagattccasaaatgcctctaaagttgcatctataagcttaatgatcttatgtctgtgtctccatggatgccaagtgatatgatttggatctctatccccacccaaatct

SEQ ID NO: 219 - DNA, 201 bp, Homo sapiens
ctgacttgcttcatacttcttcctgcctccgctagcctccacccagggaaggtgtgcttctcggtaagtcagtttgagagaagcagtgtagtgtagtggtsaatagtctggatttacatctttgatcttccatttactacgcttgtgacctagggggtgttgcttcccctctctgttccaattatttatccataaaataga

SEQ ID NO: 220 - DNA, 201 bp, Homo sapiens
taaatttccaactcatgccttttgggggacacattcaaactatagcaaatactaagttaaggaagtttcagctctgtctggcagcctcataatatttcaaygcttcatcatttgaatgcttattaattaaccaacttcctgtatgccatgtgatcagatgtcacaagaggagttcctttgggatgaacttagttctttgtg

SEQ ID NO: 221 - DNA, 201 bp, Homo sapiens
gctggaattcagatcccaggtctgtcaaagcctaatcccagccagccttccttctgttgctccaacggggagtcctactcaaaactgttcctggtcctgtrtgacagcattgataagactcctggaaatttttgttacttcctagcctccactttctaccttcccattttctcctaattttctcaatctttgttggggttt

SEQ ID NO: 222 - DNA, 201 bp, Homo sapiens
ctggttctttcccatcagtgctgtcaccaaagagaaccaccattttcatattatctgttttcgaactcatataaatggaatcgtagagcatgcgttcattktgtctaacttcttttgttcaaaattatgtctgggagattcatccatgttctagcatgtaggagccgcccaccctttttcattgctgtgtagtattctgtt

SEQ ID NO: 223 - DNA, 201 bp, Homo sapiens
aagtcataaagctgaagaaacttctgggtgttcagtgagtaaatgaatgtttgagtgcaatgtggagacagaatcatcattgcacgtcttatttataattmggattgttcatcaggttgaccttgaatcatggatcccataacagaaagttagatacggctgctttgagaactaaaaggcccaaaaagtgcagtcagatcc

SEQ ID NO: 224 - DNA, 201 bp, Homo sapiens; identical to SEQ ID NO: 36

SEQ ID NO: 225 - DNA, 201 bp, Homo sapiens; identical to SEQ ID NO: 37

SEQ ID NO: 226 - DNA, 201 bp, Homo sapiens; identical to SEQ ID NO: 38

SEQ ID NO: 227 - DNA, 201 bp, Homo sapiens; identical to SEQ ID NO: 39

SEQ ID NO: 228 - DNA, 201 bp, Homo sapiens; identical to SEQ ID NO: 40

SEQ ID NO: 229 - DNA, 201 bp, Homo sapiens; identical to SEQ ID NO: 41

SEQ ID NO: 230 - DNA, 201 bp, Homo sapiens; identical to SEQ ID NO: 42

SEQ ID NO: 231 - DNA, 201 bp, Homo sapiens
gtgagggtccagaaacttgtatgatccaggtattcgtttattgattttttttcaagtaattagtgagcatttaccatgtatgaagtgctgaggataaatartgagcaaggcaagcaggcttctgccctcacaaagctcatattctagtcctgcgtatgtgtgttggtgggggaaatgtaaacaatatacaagtaaacaaac

SEQ ID NO: 232 - DNA, 201 bp, Homo sapiens; identical to SEQ ID NO: 44

SEQ ID NO: 233 - DNA, 201 bp, Homo sapiens; identical to SEQ ID NO: 173

SEQ ID NO: 234 - DNA, 201 bp, Homo sapiens; identical to SEQ ID NO: 174

SEQ ID NO: 235 - DNA, 201 bp, Homo sapiens
tgcttactagagaccaaaatgccaagatttcaacgggagccagccaccctggtttctattttgatgtgattacttagtcatttaaagtcaggttaatgttsgccaacaacagatggggtcaggacacaggagttctgcagctcactgaaactggacagtcttttagggcacccagctcacaaggccacaccgtggcccgcc

SEQ ID NO: 236 - DNA, 201 bp, Homo sapiens
tgttttaggatcaaaataatgaaaaagaatagaaaccatttcaactcagaaaataattcaaagatgggaaaaaggtgtgtaccaaattcattgctctaatyatttctgttctgataaaaggagtttacagcaaaggaataacttttctgtgtctctgaggctttggaaaaacaaggcatcaagaagctttggggtgtggtg

SEQ ID NO: 237 - DNA, 201 bp, Homo sapiens
ggtaaaccatggatgtggttctacagatgttgccacaacaggaagacaaaatctcacagctaacagaggtcacagcttttggaaacagtggttgcgacacrgaggaaactccccctcccagccctaccccaagcacatccttgcttctctcagtcacgccagttacaccaacaggggcagctctggggaggacatttggaa

SEQ ID NO: 238 - DNA, 201 bp, Homo sapiens
ccatttcaactcagaaaataattcaaagatgggaaaaaggtgtgtaccaaattcattgctctaatcatttctgttctgataaaaggagtttacagcaaagraataacttttctgtgtctctgaggctttggaaaaacaaggcatcaagaagctttggggtgtggtgggtgtggtggggcagcctactgcttgttgaggtaa

SEQ ID NO: 239 - DNA, 201 bp, Homo sapiens
ctttgtaatgtgctattgaatttgatttgctagtattttgttgaggatttttgcatctatgttcatcaggaatattgatctatagttttatttttttgctrtgtccttgtctggttttggtattagggtgatattgatctcatagcatgaattagggataattccttcctcctcaatttttttttaatagtttcaggaaga

SEQ ID NO: 240 - DNA, 201 bp, Homo sapiens; identical to SEQ ID NO: 175

SEQ ID NO: 241 - DNA, 201 bp, Homo sapiens
tttgggtggcctcagcttccttttttttttctttgtatattctaagtggatgcttgaagtcatttcatttattgacattgtcagaatcaaaatgtggtgayatgaaatcagtcagggccaaagttgttgtactcagaaacgtagtataaatcatgcaaacactatataaagcacatttcaaatgaatcaggtatttaaaac

SEQ ID NO: 242 - DNA, 201 bp, Homo sapiens; identical to SEQ ID NO: 46

SEQ ID NO: 243 - DNA, 201 bp, Homo sapiens; identical to SEQ ID NO: 47

SEQ ID NO: 244 - DNA, 201 bp, Homo sapiens; identical to SEQ ID NO: 48

SEQ ID NO: 245 - DNA, 201 bp, Homo sapiens; identical to SEQ ID NO: 49

SEQ ID NO: 246 - DNA, 201 bp, Homo sapiens
ccaatacaggagagagctgaagggaattcccaggctgatggtgaaagatggcccacaatgacagctgtttggcaggtctagaaacccattacaggttgaarggaaaaggtggaagtctccacggtggatgttcctaagaagagtggaactgagagactactaatggattcaggtatattgagagaaattcttagggctcca

SEQ ID NO: 247 - DNA, 201 bp, Homo sapiens
taaggcttccagtcaatagaaggctgttattagttaagttctggctgagtcaaaagtgatacataaattttcaactgcatggtggggtcaacattactaamcccctcacccttcatgggtgaactgtatttttatatctatatctaatctatatatctatatatctctctatatatatttagtttgggtggcctcagcttc

SEQ ID NO: 248 - DNA, 201 bp, Homo sapiens
atgatttatgaagaaaaagaggtttaatggactcacagttccacgtggctggagagagcttacaatcatggtggaaggtgaaggaggagcaaagccatgtygtacatggaggcaggcaagagagtgtgtgcaggggaacttccctttataaagccatcggatctcgtgagacttattcgctatcacgagaagagcattgga

SEQ ID NO: 249 - DNA, 201 bp, Homo sapiens
tattggcctgaagcctgaatcatcaactcagtaaataaaatactgggaacaattaaacaaataaagtgaatactatgagagaatgagataagcctcaagakattgctaccattccagccccataggacacagtgaactggcccacactccaagtacctaactactacaaccagagcacaaagactctctatgataaaggaa

SEQ ID NO: 250 - DNA, 201 bp, Homo sapiens; identical to SEQ ID NO: 181

SEQ ID NO: 251 - DNA, 201 bp, Homo sapiens; identical to SEQ ID NO: 50

SEQ ID NO: 252 - DNA, 201 bp, Homo sapiens; identical to SEQ ID NO: 51

SEQ ID NO: 253 - DNA, 201 bp, Homo sapiens; identical to SEQ ID NO: 53

SEQ ID NO: 254 - DNA, 201 bp, Homo sapiens; identical to SEQ ID NO: 54

SEQ ID NO: 255 - DNA, 201 bp, Homo sapiens; identical to SEQ ID NO: 55

SEQ ID NO: 256 - DNA, 201 bp, Homo sapiens
gaatggatagcaaacgcacaggctctggagtgggagcaagcttggtgtgttgagggatagaaatacacagagcatggcaaatacagcaagtggtgtgaaayggggttggaaaaggtggcgcaggccagatcactaggaccaaggagtttgaaatttattcctagtgcagtatatcaggttgtatttttatcactggataat

SEQ ID NO: 257 - DNA, 201 bp, Homo sapiens
atcctcagaagtgggcggcagagaaggaggaacgtgcttgagtcgcagtccccaaaaagggaggaactcattggcccagcttaggcctggtgtctgcctayctgtggttcagtcagctgtggtcggtgggcaggacacacctgaaggagcatatcttggctgtgtgggttgggcagacatcccacaatgctcatgtagggg

SEQ ID NO: 258 - DNA, 201 bp, Homo sapiens
gtggtctgaacgtttatgtctccctaaaattcatatgttgaattcctaacccccaaggtgagagtgttgggaggtggagccttttagtctcctggctgggmttagtggcctgataacatagactccagagagctggcttattccttccactatgtgaggacacagcaagaagccgctgtctgtggggaaacagaggcttac

SEQ ID NO: 259 - DNA, 201 bp, Homo sapiens; identical to SEQ ID NO: 189

SEQ ID NO: 260 - DNA, 201 bp, Homo sapiens; identical to SEQ ID NO: 58

SEQ ID NO: 261 - DNA, 201 bp, Homo sapiens
atgtcaccaacaagaggctaccccctggggaaacctaacaggaaaaaggtagttgagccaggaaaagccaccagaccctttctcttggcttgaggcatcayatacatttgaataataatcaaattaacaatgtaatatgactgtttagcaacaatgatgtgctaatcatggttttacatggattatctttagtcattaaat

SEQ ID NO: 262 - DNA, 201 bp, Homo sapiens; identical to SEQ ID NO: 193

SEQ ID NO: 263 - DNA, 201 bp, Homo sapiens; identical to SEQ ID NO: 194

SEQ ID NO: 264 - DNA, 201 bp, Homo sapiens
gttattttttcttcttacaaaagttgttattcaaggattattagcagccaccattaattaggcacttcattatactgttttacttacctcatactcacccrattattgaagcagggattcctgccctaggattatagggatggccgacacttgacacttgacactgaacagatgagattgacagcagcttgtcagtcacac

SEQ ID NO: 265 - DNA, 201 bp, Homo sapiens
aaagaacgttattgatggaaatttaggggtgtttggggaatattactaaaatttgtgtgtaaccaaatttgtgaccttctaacaaatgtccccctgtagasctgtgagaaacaatattagggttgacccactcagttcatgcttttttttttttctgttaaaaaaagccagcatttcaagcagtgagtagaccagtaagct

SEQ ID NO: 266 - DNA, 201 bp, Homo sapiens; identical to SEQ ID NO: 63

SEQ ID NO: 267 - DNA, 201 bp, Homo sapiens; identical to SEQ ID NO: 64

SEQ ID NO: 268 - DNA, 201 bp, Homo sapiens; identical to SEQ ID NO: 65

SEQ ID NO: 269 - DNA, 206 bp, Homo sapiens; identical to SEQ ID NO: 66

SEQ ID NO: 270 - DNA, 201 bp, Homo sapiens
ttatcaattcttcatttcatggattgtgtctttggtgttatatctaaaaagtcatcaccaaacgctagatcatctagattttattctatgttatgatctargagttttataggttcacattttatatttaggtctgtgaattagtttttgtgaaaactgtaaggtctgtgtctagttgatgttcagttattctaatatcat

SEQ ID NO: 271 - DNA, 201 bp, Homo sapiens
taatacatataatacagaaaatatctgttaattggctatactattcataaggcttccagtcaatagaaggctgttattagttaagttctggctgagtcaaragtgatacataaattttcaactgcatggtggggtcaacattactaaacccctcacccttcatgggtgaactgtatttttatatctatatctaatctatat

SEQ ID NO: 272 - DNA, 201 bp, Homo sapiens
actgaggacaaactagggagtggtggggaccacagtgaacccatggcgcatgctctttcccagaggcaggtcgctcctcagatccagctgactgtgccagmtgtgaaagcaagatgggcatcacagttcttgtgatgtttagagaagagctggaaaactgaacttaaatgtgaagtagctattttaaaggctggccacaat

SEQ ID NO: 273 - DNA, 201 bp, Homo sapiens; identical to SEQ ID NO: 70

SEQ ID NO: 274 - DNA, 201 bp, Homo sapiens; identical to SEQ ID NO: 71

SEQ ID NO: 275 - DNA, 201 bp, Homo sapiens; identical to SEQ ID NO: 72

SEQ ID NO: 276 - DNA, 201 bp, Homo sapiens
agagttctaattcactaaacaaaacctcagtatacaccaaaatagaacctccttaaagcataaatctcacatgccctgcaaaacagtaacgcaatgaaaaraacaaagtatctaggcaacaactaacatgatgaatagaacagcacctcacatctccatattaactttgaatgtaaatggcccaaatgctccacttgagag

SEQ ID NO: 277 - DNA, 201 bp, Homo sapiens; identical to SEQ ID NO: 74

SEQ ID NO: 278 - DNA, 201 bp, Homo sapiens; identical to SEQ ID NO: 205

SEQ ID NO: 279 - DNA, 201 bp, Homo sapiens; identical to SEQ ID NO: 206

SEQ ID NO: 280 - DNA, 201 bp, Homo sapiens; identical to SEQ ID NO: 207

SEQ ID NO: 281 - DNA, 201 bp, Homo sapiens; identical to SEQ ID NO: 208

SEQ ID NO: 282 - DNA, 201 bp, Homo sapiens; identical to SEQ ID NO: 76

SEQ ID NO: 283 - DNA, 201 bp, Homo sapiens
cagtggaaataaatatttgatgttattttcaataaattgttactggagttaaacctcttgctatcctgacaattcctccctacatcaccctctttgcaatrgcagatggaagaattggcaataaatgcaattcagcttgaagaaaacaccctaaatattagaaacctgtgaagaaccaccggattgccttatcaactcatt

SEQ ID NO: 284 - DNA, 201 bp, Homo sapiens; identical to SEQ ID NO: 79

SEQ ID NO: 285 - DNA, 201 bp, Homo sapiens; identical to SEQ ID NO: 83

SEQ ID NO: 286 - DNA, 201 bp, Homo sapiens; identical to SEQ ID NO: 84

SEQ ID NO: 287 - DNA, 201 bp, Homo sapiens; identical to SEQ ID NO: 11

SEQ ID NO: 288 - DNA, 201 bp, Homo sapiens
gaccttgaactccagggctcaaataatctgcccaccttggcctcccaaagtgctaggattacaggcatgagccaatatgcccagccaaatatcttaatcamcatcatcatcatcatcataaactgccggtaggaagtttggcataatgtgtcacatcaattataaatcacagatgattttacttgatatagttagctagag

SEQ ID NO: 289 - DNA, 201 bp, Homo sapiens; identical to SEQ ID NO: 88

SEQ ID NO: 290 - DNA, 201 bp, Homo sapiens; identical to SEQ ID NO: 92

SEQ ID NO: 291 - DNA, 201 bp, Homo sapiens
aattaggcctgcgaaagagacagactccttccagtgacagagtgttaggtggcaagttcagaagctgtcagtcttgtttttctccatgtggccagaatgamaggaagatggcccatagacgcagaataagaagaataataaacagatccacagaaaaggacagaggagagatgaaatgagaaccctgaatgcattagaatc

SEQ ID NO: 292 - DNA, 201 bp, Homo sapiens; identical to SEQ ID NO: 12

SEQ ID NO: 293 - DNA, 201 bp, Homo sapiens
ggcctccccagccatatggaactgtaagtccattaaatctcttttttttgcaaattgcccagtcttgggtatgtctttaccagcagcgtgaaaatggactwatacagcatttaccacagtgtctggctcatagtaactgtggcagagcctgctaattgtccgttcaacttccgttctcaaattcttacttcctaacagaac

SEQ ID NO: 294 - DNA, 201 bp, Homo sapiens; identical to SEQ ID NO: 95

SEQ ID NO: 295 - DNA, 201 bp, Homo sapiens; identical to SEQ ID NO: 96

SEQ ID NO: 296 - DNA, 201 bp, Homo sapiens
tttataaacagctaatcggaacctctatttgtcataggcttttgagtttattgttgggacccataataggaccattttttctttttgtcttcaaaattatygtaggccaggtgcagtggcttacacctgtaatcccagcacttcgggaggctgaggcgggtggatcaagtgaggtcaggagttcaaaaccagcctggccaa

SEQ ID NO: 297 - DNA, 201 bp, Homo sapiens
agccagttaatgtctttaacaataagtgttaaggagcagctgctgcacttggataacaagtaattcaaggcgcccacttaacagaaatgttaaactataasaagaaccatctgaggattaacagaaactttttttttgtagatttcaagggaacttgcctttcagaataatagtacctaaagtatttataaacagctaatc

SEQ ID NO: 298 - DNA, 201 bp, Homo sapiens; identical to SEQ ID NO: 97

SEQ ID NO: 299 - DNA, 201 bp, Homo sapiens
agtcctggaaaaacaagacagcctcagctcagtagttcccatacaaattccaatgtttagattgtttggcataactggagtcacatgcttatccatgaacyaaataatcatcgttgacaggaaatatggtattctcattggccaggtcaagtcacatgctcaccagaggggtgatggggaactagctccactcttgcgcgt

SEQ ID NO: 300 - DNA, 201 bp, Homo sapiens
gaatggcctaggaaagttacattccagaaggaaacatgttattacacataggaatcgattggtcctccatgagtacctacaattgaattctatgtattaamaccgcagaaaaacacatacagatagaaaatatttttaatcaaggactagtatccaaagcaaaacaaagtggaaatttggtaattatcctgtgaatttctg

SEQ ID NO: 301 - DNA, 201 bp, Homo sapiens
aacgactcttggtgtcttccagcgctaatgatttataattaagttagatttgtaaccttaaaatactttatagcatttaccctgcttgtgagtgtgtatasatttaacagaattcaacaagcacgtgctgagaaaattctttacccagggcattcagctacctacagtatagtcagagggaaataaaacatggtttggaat

SEQ ID NO: 302 - DNA, 201 bp, Homo sapiens
gctcatgcttatgaaattcactggtcttaccatgttccccatcatcctgaagaagctggattgatataatggtggaatggcctattgaagtcacaattacwgtgccaactagatgacaatactttgcagggctgggacaaagttctccagaaggccgggtatgctctgaatcagtgtccaatatgttactgtttctcccaa

SEQ ID NO: 303 - DNA, 201 bp, Homo sapiens; identical to SEQ ID NO: 102

SEQ ID NO: 304 - DNA, 201 bp, Homo sapiens
actgcaaatcatctaagaagagaaaaacccctctgaattacatgactgagtttcagaatgtgagtaaagtatggctaaccaaaatgttcaagcaaactgawgcaaatttccttttctatgactgtgtaagcaaaactcttttgcacgatactaagtttgatgtggtgtagcatgtaaaagagaaagcacctttatctgtgt

SEQ ID NO: 305 - DNA, 201 bp, Homo sapiens; identical to SEQ ID NO: 106

SEQ ID NO: 306 - DNA, 201 bp, Homo sapiens
tctcttttttttgcaaattgcccagtcttgggtatgtctttaccagcagcgtgaaaatggacttatacagcatttaccacagtgtctggctcatagtaacwgtggcagagcctgctaattgtccgttcaacttccgttctcaaattcttacttcctaacagaacccctatgtcattgatgatagcagttctctcagtgaaa

SEQ ID NO: 307 - DNA, 201 bp, Homo sapiens
atttcctttggctgtgcagaggcagcacatacctcacctggggtggtgagtgtgctttattttaatcaagccgagtgtattcatagcttttcttcttggtrtccttgtgctttcagtctggctttctcatcctgtaataaatgtttaagtaggaaggaggctaaagagaaggtggaagagagacagagtgagtgacagaaa

SEQ ID NO: 308 - DNA, 20 bp, Homo sapiens
ccaaaaccagacaaggacat

SEQ ID NO: 309 - DNA, 20 bp, Homo sapiens
ccaaaaccagacaaggacac

SEQ ID NO: 310 - DNA, 24 bp, Homo sapiens
gctgcaatgcctggtgagtattat

SEQ ID NO: 311 - DNA, 19 bp, Homo sapiens
gggttgtccatgacctcta

SEQ ID NO: 312 - DNA, 18 bp, Homo sapiens
ggttgtccatgacctctg

SEQ ID NO: 313 - DNA, 23 bp, Homo sapiens
ccactgagcgggtaaacacttag

SEQ ID NO: 314 - DNA, 26 bp, Homo sapiens
gggcactctgaattatcaatcaatta

SEQ ID NO: 315 - DNA, 25 bp, Homo sapiens
ggcactctgaattatcaatcaattg

SEQ ID NO: 316 - DNA, 24 bp, Homo sapiens
tcaaggtgtaggtaggtctgtgta

SEQ ID NO: 317 - DNA, 23 bp, Homo sapiens
aattttagccattcttctgccta

SEQ ID NO: 318 - DNA, 21 bp, Homo sapiens
ttttagccattcttctgcctc

SEQ ID NO: 319 - DNA, 26 bp, Homo sapiens
aaatacatgaggcgtccacataatgc

SEQ ID NO: 320 - DNA, 19 bp, Homo sapiens
ggccctgactgatttcatg

SEQ ID NO: 321 - DNA, 20 bp, Homo sapiens
tggccctgactgatttcata

SEQ ID NO: 322 - DNA, 18 bp, Homo sapiens
ggtggcctcagcttcctt

SEQ ID NO: 323 - DNA, 20 bp, Homo sapiens
tgcaaaaacctacccagttt

SEQ ID NO: 324 - DNA, 20 bp, Homo sapiens
tgcaaaaacctacccagttc

SEQ ID NO: 325 - DNA, 24 bp, Homo sapiens
ttcattagacaacagaggagacat

SEQ ID NO: 326 - DNA, 31 bp, Homo sapiens
taataggaaactaatatagaagatgatgact

SEQ ID NO: 327 - DNA, 28 bp, Homo sapiens
taggaaactaatatagaagatgatgacc

SEQ ID NO: 328 - DNA, 25 bp, Homo sapiens
atgtttgccaagttggtcttgaact

SEQ ID NO: 329 - DNA, 17 bp, Homo sapiens
ctctccctggggatgaa

SEQ ID NO: 330 - DNA, 17 bp, Homo sapiens
ctctccctggggatgag

SEQ ID NO: 331 - DNA, 26 bp, Homo sapiens
caattgactgtaactgctccaagaca

SEQ ID NO: 332 - DNA, 19 bp, Homo sapiens
attgcctttcccaacaagt

SEQ ID NO: 333 - DNA, 17 bp, Homo sapiens
tgcctttcccaacaagc

SEQ ID NO: 334 - DNA, 22 bp, Homo sapiens
aattttggtcccaccgctcatt

SEQ ID NO: 335 - DNA, 19 bp, Homo sapiens
cggccatggttctaagaaa

SEQ ID NO: 336 - DNA, 19 bp, Homo sapiens
cggccatggttctaagaag

SEQ ID NO: 337 - DNA, 21 bp, Homo sapiens
gaaatgtgggctgagggatag

SEQ ID NO: 338 - DNA, 27 bp, Homo sapiens
ttacttcctacatttacaacctagaat

SEQ ID NO: 339 - DNA, 25 bp, Homo sapiens
acttcctacatttacaacctagaac

SEQ ID NO: 340 - DNA, 25 bp, Homo sapiens
gaggagacctcaaagcagaacctta

SEQ ID NO: 341 - DNA, 25 bp, Homo sapiens
ctccttaagaagagagatcaacaag

SEQ ID NO: 342 - DNA, 25 bp, Homo sapiens
ctccttaagaagagagatcaacaaa

SEQ ID NO: 343 - DNA, 24 bp, Homo sapiens
tggtctcaatctcctgaccttgtg

SEQ ID NO: 344 - DNA, 21 bp, Homo sapiens
ctgggaatcagatgattgagc

SEQ ID NO: 345 - DNA, 21 bp, Homo sapiens
ctgggaatcagatgattgagg

SEQ ID NO: 346 - DNA, 27 bp, Homo sapiens
gtgtaaatctgccaattagccatctct

SEQ ID NO: 347 - DNA, 24 bp, Homo sapiens
gctctacctttatgcactgtttta

SEQ ID NO: 348 - DNA, 23 bp, Homo sapiens
ctctacctttatgcactgttttg

SEQ ID NO: 349 - DNA, 30 bp, Homo sapiens
gtcacaatgaaatactagtcaggactctca

SEQ ID NO: 350 - DNA, 30 bp, Homo sapiens
gcagtggagttattagaagttatttagatg

SEQ ID NO: 351 - DNA, 30 bp, Homo sapiens
gcagtggagttattagaagttatttagata

SEQ ID NO: 352 - DNA, 20 bp, Homo sapiens
gtgccctgtggggttaaaca

SEQ ID NO: 353 - DNA, 22 bp, Homo sapiens
gatgcaactttagaggcatttg

SEQ ID NO: 354 - DNA, 22 bp, Homo sapiens
gatgcaactttagaggcatttc

SEQ ID NO: 355 - DNA, 25 bp, Homo sapiens
ttaggactggaaaccacgaagtcaa

SEQ ID NO: 356 - DNA, 27 bp, Homo sapiens
gatcaaagatgtaaatccagactattg

SEQ ID NO: 357 - DNA, 27 bp, Homo sapiens
gatcaaagatgtaaatccagactattc

SEQ ID NO: 358 - DNA, 29 bp, Homo sapiens
cctctgtgttcacactgatatcaatacct

SEQ ID NO: 359 - DNA, 23 bp, Homo sapiens
tggcagcctcataatatttcaac

SEQ ID NO: 360 - DNA, 23 bp, Homo sapiens
tggcagcctcataatatttcaat

SEQ ID NO: 361 - DNA, 25 bp, Homo sapiens
caaaggaactcctcttgtgacatct

SEQ ID NO: 362 - DNA, 29 bp, Homo sapiens
aattaactttagaatcagacttgatacag

SEQ ID NO: 363 - DNA, 30 bp, Homo sapiens
aaattaactttagaatcagacttgatacaa

SEQ ID NO: 364 - DNA, 20 bp, Homo sapiens
cagcccaggagttggacaag

SEQ ID NO: 365 - DNA, 21 bp, Homo sapiens
ttcgatcaggcagtaggatat

SEQ ID NO: 366 - DNA, 20 bp, Homo sapiens
tcgatcaggcagtaggatac

SEQ ID NO: 367 - DNA, 28 bp, Homo sapiens
cattttgttggttactaacagcactgaa

SEQ ID NO: 368 - DNA, 26 bp, Homo sapiens
caaccaagaaatagtcatttacagaa

SEQ ID NO: 369 - DNA, 26 bp, Homo sapiens
caaccaagaaatagtcatttacagag

SEQ ID NO: 370 - DNA, 23 bp, Homo sapiens
atcaggagctggaggaaacttct

SEQ ID NO: 371 - DNA, 19 bp, Homo sapiens
ggggtgctgtgtttctttc

SEQ ID NO: 372 - DNA, 19 bp, Homo sapiens
ggggtgctgtgtttctttt

SEQ ID NO: 373 - DNA, 34 bp, Homo sapiens
ctaacagctgtaatgaggtatagttcacatactc

SEQ ID NO: 374 - DNA, 19 bp, Homo sapiens
caatgagcatttagcatcg

SEQ ID NO: 375 - DNA, 21 bp, Homo sapiens
ttcaatgagcatttagcatct

SEQ ID NO: 376 - DNA, 23 bp, Homo sapiens
tggaggaaaagtggaagatatta

SEQ ID NO: 377 - DNA, 21 bp, Homo sapiens
attttcatcctggatcagaac

SEQ ID NO: 378 - DNA, 21 bp, Homo sapiens
attttcatcctggatcagaat

SEQ ID NO: 379 - DNA, 20 bp, Homo sapiens
agttgcccaggatcatatgt

SEQ ID NO: 380 - DNA, 23 bp, Homo sapiens
gctaaagacttgctaagagtttg

SEQ ID NO: 381 - DNA, 24 bp, Homo sapiens
tgctaaagacttgctaagagttta

SEQ ID NO: 382 - DNA, 25 bp, Homo sapiens
tgtgtaacttcaggaaaatgtctta

SEQ ID NO: 383 - DNA, 18 bp, Homo sapiens
ggaattctgctgtaaggc

SEQ ID NO: 384 - DNA, 20 bp, Homo sapiens
aaggaattctgctgtaaggt

SEQ ID NO: 385 - DNA, 20 bp, Homo sapiens
ctcctggctgttccagatat

SEQ ID NO: 386 - DNA, 21 bp, Homo sapiens
actaggaactctctccccaat

SEQ ID NO: 387 - DNA, 20 bp, Homo sapiens
ctaggaactctctccccaag

SEQ ID NO: 388 - DNA, 20 bp, Homo sapiens
tgttgtcccctctgactctc

SEQ ID NO: 389 - DNA, 21 bp, Homo sapiens
gcaccaaagaaagggataaac

SEQ ID NO: 390 - DNA, 21 bp, Homo sapiens
gcaccaaagaaagggataaaa

SEQ ID NO: 391 - DNA, 21 bp, Homo sapiens
cctcatcgagttttggagtct

SEQ ID NO: 392 - DNA, 25 bp, Homo sapiens
cacagtaaattcggtgttagttatc

SEQ ID NO: 393 - DNA, 25 bp, Homo sapiens
cacagtaaattcggtgttagttatt

SEQ ID NO: 394 - DNA, 22 bp, Homo sapiens
tccactggtgatttaaaacaga

SEQ ID NO: 395 - DNA, 24 bp, Homo sapiens
caagctatgtgtgttcctgataaa

SEQ ID NO: 396 - DNA, 23 bp, Homo sapiens
aagctatgtgtgttcctgataac

SEQ ID NO: 397 - DNA, 25 bp, Homo sapiens
cacatgtttgggctcatttctatca

SEQ ID NO: 398 - DNA, 23 bp, Homo sapiens
gcccagccaaatatcttaatcaa

SEQ ID NO: 399 - DNA, 23 bp, Homo sapiens
gcccagccaaatatcttaatcac

SEQ ID NO: 400 - DNA, 26 bp, Homo sapiens
cccctgtggattatctctagctaact

SEQ ID NO: 401 - DNA, 21 bp, Homo sapiens
ggtggggtcaacattactaaa

SEQ ID NO: 402 - DNA, 21 bp, Homo sapiens
ggtggggtcaacattactaac

SEQ ID NO: 403 - DNA, 23 bp, Homo sapiens
gctgaggccacccaaactaaata

SEQ ID NO: 404 - DNA, 23 bp, Homo sapiens
gagaatgagataagcctcaagag

SEQ ID NO: 405 - DNA, 24 bp, Homo sapiens
agagaatgagataagcctcaagat

SEQ ID NO: 406 - DNA, 28 bp, Homo sapiens
catagagagtctttgtgctctggttgta

SEQ ID NO: 407 - DNA, 20 bp, Homo sapiens
tcacactgtcagacacatct

SEQ ID NO: 408 - DNA, 19 bp, Homo sapiens
cacactgtcagacacatcc

SEQ ID NO: 409 - DNA, 24 bp, Homo sapiens
aaggggcttcttgagaggaaatga

SEQ ID NO: 410 - DNA, 22 bp, Homo sapiens
ctacatcaccctctttgcaata

SEQ ID NO: 411 - DNA, 20 bp, Homo sapiens
acatcaccctctttgcaatg

SEQ ID NO: 412 - DNA, 26 bp, Homo sapiens
cggtggttcttcacaggtttctaata

SEQ ID NO: 413 - DNA, 22 bp, Homo sapiens
tttatcacaatgcaaacttcgc

SEQ ID NO: 414 - DNA, 23 bp, Homo sapiens
ctttatcacaatgcaaacttcgt

SEQ ID NO: 415 - DNA, 25 bp, Homo sapiens
ctgcagggattgactggttttgtta

SEQ ID NO: 416 - DNA, 23 bp, Homo sapiens
agcttttgcaagctcaaaattac

SEQ ID NO: 417 - DNA, 23 bp, Homo sapiens
agcttttgcaagctcaaaattaa

SEQ ID NO: 418 - DNA, 22 bp, Homo sapiens
caggccaccactgtgaaagtaa

SEQ ID NO: 419 - DNA, 19 bp, Homo sapiens
agtgcttttgcgacatgat

SEQ ID NO: 420 - DNA, 18 bp, Homo sapiens
gtgcttttgcgacatgac

SEQ ID NO: 421 - DNA, 29 bp, Homo sapiens
aggacagtcctggagactatctttaaaga

SEQ ID NO: 422 - DNA, 23 bp, Homo sapiens
gctttgtcagaactgctactaac

SEQ ID NO: 423 - DNA, 23 bp, Homo sapiens
gctttgtcagaactgctactaag

SEQ ID NO: 424 - DNA, 23 bp, Homo sapiens
cagtgtccaagaaggcttgactt

SEQ ID NO: 425 - DNA, 18 bp, Homo sapiens
acaacagacggctgagta

SEQ ID NO: 426 - DNA, 17 bp, Homo sapiens
caacagacggctgagtc

SEQ ID NO: 427 - DNA, 24 bp, Homo sapiens
agtggttctcaaggtgtggtctta

SEQ ID NO: 428 - DNA, 25 bp, Homo sapiens
gctgttgtcctcattatacaaatgg

SEQ ID NO: 429 - DNA, 25 bp, Homo sapiens
gctgttgtcctcattatacaaatga

SEQ ID NO: 430 - DNA, 27 bp, Homo sapiens
ctcccgttaattcccaaagtgttactt

SEQ ID NO: 431 - DNA, 20 bp, Homo sapiens
tgggcaatcatatccactct

SEQ ID NO: 432 - DNA, 19 bp, Homo sapiens
gggcaatcatatccactcc

SEQ ID NO: 433 - DNA, 20 bp, Homo sapiens
gccctttgccaagcgatact

SEQ ID NO: 434 - DNA, 17 bp, Homo sapiens
gctgactgaaccacagg

SEQ ID NO: 435 - DNA, 18 bp, Homo sapiens
agctgactgaaccacaga

SEQ ID NO: 436 - DNA, 18 bp, Homo sapiens
gaagtgggcggcagagaa

SEQ ID NO: 437 - DNA, 24 bp, Homo sapiens
agtctatgttatcaggccactaat

SEQ ID NO: 438 - DNA, 23 bp, Homo sapiens
gtctatgttatcaggccactaag

SEQ ID NO: 439 - DNA, 25 bp, Homo sapiens
gatgctgtggtctgaacgtttatgt

SEQ ID NO: 440 - DNA, 18 bp, Homo sapiens
cttcctcatgcccaaagg

SEQ ID NO: 441 - DNA, 19 bp, Homo sapiens
tcttcctcatgcccaaagt

SEQ ID NO: 442 - DNA, 24 bp, Homo sapiens
gaggtgacagcgattagggagtag

SEQ ID NO: 443 - DNA, 20 bp, Homo sapiens
gcccttctcagtgaatctcg

SEQ ID NO: 444 - DNA, 20 bp, Homo sapiens
gcccttctcagtgaatctca

SEQ ID NO: 445 - DNA, 24 bp, Homo sapiens
ctggtggacagacacaacctaaac

SEQ ID NO: 446 - DNA, 25 bp, Homo sapiens
tgataagaggcagagtttaattcaa

SEQ ID NO: 447 - DNA, 25 bp, Homo sapiens
tgataagaggcagagtttaattcac

SEQ ID NO: 448 - DNA, 25 bp, Homo sapiens
cacacacccttgggcattaattagt

SEQ ID NO: 449 - DNA, 17 bp, Homo sapiens
cagccttggagttcacc

SEQ ID NO: 450 - DNA, 18 bp, Homo sapiens
gcagccttggagttcact

SEQ ID NO: 451 - DNA, 23 bp, Homo sapiens
tgtgctcagcagaaaagatatat

SEQ ID NO: 452 - DNA, 18 bp, Homo sapiens
cagggtgtcgagaacaac

SEQ ID NO: 453 - DNA, 19 bp, Homo sapiens
tcagggtgtcgagaacaat

SEQ ID NO: 454 - DNA, 27 bp, Homo sapiens
ctcagtcaaatgtaaggcagatactgt

SEQ ID NO: 455 - DNA, 18 bp, Homo sapiens
cccatgtgggaaagttcg

SEQ ID NO: 456 - DNA, 19 bp, Homo sapiens
tcccatgtgggaaagttca

SEQ ID NO: 457 - DNA, 30 bp, Homo sapiens
ctcagaacagcctaaattttagggctttat

SEQ ID NO: 458 - DNA, 22 bp, Homo sapiens
gcgctaattacactaccaaatg

SEQ ID NO: 459 - DNA, 25 bp, Homo sapiens
gtagcgctaattacactaccaaata

SEQ ID NO: 460 - DNA, 30 bp, Homo sapiens
gaactctataactgcctagcaagattatgc

SEQ ID NO: 461 - DNA, 20 bp, Homo sapiens
caatggcaaagctgttagtg

SEQ ID NO: 462 - DNA, 21 bp, Homo sapiens
acaatggcaaagctgttagtt

SEQ ID NO: 463 - DNA, 25 bp, Homo sapiens
gctgggattataggtgtgcactact

SEQ ID NO: 464 - DNA, 18 bp, Homo sapiens
actgcttctagcccagtt

SEQ ID NO: 465 - DNA, 18 bp, Homo sapiens
actgcttctagcccagtg

SEQ ID NO: 466 - DNA, 24 bp, Homo sapiens
acctaaggcaagccatctgataca

SEQ ID NO: 467 - DNA, 25 bp, Homo sapiens
tctaccaatcaataaggtaagacag

SEQ ID NO: 468 - DNA, 27 bp, Homo sapiens
cttctaccaatcaataaggtaagacaa

SEQ ID NO: 469 - DNA, 22 bp, Homo sapiens
gccaggcaccttctcagtctat

SEQ ID NO: 470 - DNA, 19 bp, Homo sapiens
tccatgtggccagaatgaa

SEQ ID NO: 471 - DNA, 18 bp, Homo sapiens
ccatgtggccagaatgac

SEQ ID NO: 472 - DNA, 26 bp, Homo sapiens
gcattcagggttctcatttcatctct

SEQ ID NO: 473 - DNA, 22 bp, Homo sapiens
acactgtggtaaatgctgtatt

SEQ ID NO: 474 - DNA, 23 bp, Homo sapiens
gacactgtggtaaatgctgtata

SEQ ID NO: 475 - DNA, 23 bp, Homo sapiens
cccagccatatggaactgtaagt

SEQ ID NO: 476 - DNA, 20 bp, Homo sapiens
aggcagctttctcatattgc

SEQ ID NO: 477 - DNA, 22 bp, Homo sapiens
caaggcagctttctcatattga

SEQ ID NO: 478 - DNA, 25 bp, Homo sapiens
atcgtgaatgaggagttgccatcta

SEQ ID NO: 479 - DNA, 20 bp, Homo sapiens
tccctgtggatgaactgtat

SEQ ID NO: 480 - DNA, 20 bp, Homo sapiens
tccctgtggatgaactgtaa

SEQ ID NO: 481 - DNA, 25 bp, Homo sapiens
gattggccaagactcagttactgtt

SEQ ID NO: 482 - DNA, 23 bp, Homo sapiens
gggaagcaaaattaacctttact

SEQ ID NO: 483 - DNA, 23 bp, Homo sapiens
gggaagcaaaattaacctttacc

SEQ ID NO: 484 - DNA, 25 bp, Homo sapiens
cacatttgccagagatgcacttcta

SEQ ID NO: 485 - DNA, 26 bp, Homo sapiens
tgaagctcaccactaagaatttatac

SEQ ID NO: 486 - DNA, 26 bp, Homo sapiens
tgaagctcaccactaagaatttatat

SEQ ID NO: 487 - DNA, 23 bp, Homo sapiens
cacaactaccccaggaaacaact

SEQ ID NO: 488 - DNA, 22 bp, Homo sapiens
gatgggttaaaatgggcaattc

SEQ ID NO: 489 - DNA, 23 bp, Homo sapiens
tgatgggttaaaatgggcaatta

SEQ ID NO: 490 - DNA, 25 bp, Homo sapiens
gctaacagttgcttccatctctaca

SEQ ID NO: 491 - DNA, 25 bp, Homo sapiens
tgtatgaagtgctgaggataaataa

SEQ ID NO: 492 - DNA, 25 bp, Homo sapiens
tgtatgaagtgctgaggataaatag

SEQ ID NO: 493 - DNA, 23 bp, Homo sapiens
atttcccccaccaacacacatac

SEQ ID NO: 494 - DNA, 27 bp, Homo sapiens
ctaataaataatgaatatgctgcacca

SEQ ID NO: 495 - DNA, 24 bp, Homo sapiens
ataaataatgaatatgctgcaccg

SEQ ID NO: 496 - DNA, 22 bp, Homo sapiens
gcttccagctccatccaagttg

SEQ ID NO: 497 - DNA, 16 bp, Homo sapiens
tcaccaggtcactgcc

SEQ ID NO: 498 - DNA, 17 bp, Homo sapiens
ttcaccaggtcactgct

SEQ ID NO: 499 - DNA, 25 bp, Homo sapiens
gcagttttctgcctccaggaaatac

SEQ ID NO: 500 - DNA, 17 bp, Homo sapiens
tttttgcggcagatgac

SEQ ID NO: 501 - DNA, 17 bp, Homo sapiens
tttttgcggcagatgaa

SEQ ID NO: 502 - DNA, 21 bp, Homo sapiens
ggcttgttttgggagagtatg

SEQ ID NO: 503 - DNA, 22 bp, Homo sapiens
gatggtcacagttatgattccc

SEQ ID NO: 504 - DNA, 22 bp, Homo sapiens
gatggtcacagttatgattcct

SEQ ID NO: 505 - DNA, 22 bp, Homo sapiens
cctgggtgacagaatgagactc

SEQ ID NO: 506 - DNA, 18 bp, Homo sapiens
ctcccacggcttgtaatc

SEQ ID NO: 507 - DNA, 18 bp, Homo sapiens
ctcccacggcttgtaatt

SEQ ID NO: 508 - DNA, 27 bp, Homo sapiens
gcacatttagccaatttcaacacatat

SEQ ID NO: 509 - DNA, 21 bp, Homo sapiens
tggagctcaaatgttggttag

SEQ ID NO: 510 - DNA, 21 bp, Homo sapiens
tggagctcaaatgttggttac

SEQ ID NO: 511 - DNA, 23 bp, Homo sapiens
cctgttcttgcaaggaggtgatc

SEQ ID NO: 512 - DNA, 20 bp, Homo sapiens
catctgtctgcttctcacag

SEQ ID NO: 513 - DNA, 20 bp, Homo sapiens
catctgtctgcttctcacat

SEQ ID NO: 514 - DNA, 20 bp, Homo sapiens
gtctggaaggcaaaaagatc

SEQ ID NO: 515 - DNA, 17 bp, Homo sapiens
ggccagtcctcacacat

SEQ ID NO: 516 - DNA, 17 bp, Homo sapiens
ggccagtcctcacacag

SEQ ID NO: 517 - DNA, 25 bp, Homo sapiens
aagactcccaaggatagcgtgttag

SEQ ID NO: 518 - DNA, 21 bp, Homo sapiens
tggacattttgttgtgtttgc

SEQ ID NO: 519 - DNA, 22 bp, Homo sapiens
ttggacattttgttgtgtttgg

SEQ ID NO: 520 - DNA, 24 bp, Homo sapiens
ccacccatatcacatgtcatcagt

SEQ ID NO: 521 - DNA, 28 bp, Homo sapiens
ttagtcatttaaagtcaggttaatgttc

SEQ ID NO: 522 - DNA, 27 bp, Homo sapiens
tagtcatttaaagtcaggttaatgttg

SEQ ID NO: 523 - DNA, 17 bp, Homo sapiens
cggtgtggccttgtgag

SEQ ID NO: 524 - DNA, 25 bp, Homo sapiens
gtgtaccaaattcattgctctaatc

SEQ ID NO: 525 - DNA, 25 bp, Homo sapiens
gtgtaccaaattcattgctctaatt

SEQ ID NO: 526 - DNA, 23 bp, Homo sapiens
caaagcttcttgatgccttgttt

SEQ ID NO: 527 - DNA, 18 bp, Homo sapiens
ggcacacaccaccatttc

SEQ ID NO: 528 - DNA, 18 bp, Homo sapiens
ggcacacaccaccatttg

SEQ ID NO: 529 - DNA, 21 bp, Homo sapiens
ggcaaagacaggcagatcact

SEQ ID NO: 530 - DNA, 21 bp, Homo sapiens
ggagaaactcagtgccaattt

SEQ ID NO: 531 - DNA, 21 bp, Homo sapiens
ggagaaactcagtgccaattc

SEQ ID NO: 532 - DNA, 29 bp, Homo sapiens
cattgagtatttctaagctgctcgataga

SEQ ID NO: 533 - DNA, 22 bp, Homo sapiens
ggaatgtcatccagccataaag

SEQ ID NO: 534 - DNA, 22 bp, Homo sapiens
ggaatgtcatccagccataaaa

SEQ ID NO: 535 - DNA, 24 bp, Homo sapiens
gcctttcgtgtgggttctttaact

SEQ ID NO: 536 - DNA, 18 bp, Homo sapiens
aactgacgaccaagacca

SEQ ID NO: 537 - DNA, 17 bp, Homo sapiens
actgacgaccaagaccg

SEQ ID NO: 538 - DNA, 23 bp, Homo sapiens
tgagtggtgcctgccttactatt

SEQ ID NO: 539 - DNA, 17 bp, Homo sapiens
ctgtctccgagagaggg

SEQ ID NO: 540 - DNA, 19 bp, Homo sapiens
tctccgagagaggctctaa

SEQ ID NO: 541 - DNA, 21 bp, Homo sapiens
gggctgatgcttggagattgt

What is claimed is:

1. A method for treating psoriasis in a human, the method comprising testing nucleic acid from said human for a polymorphism rs12522665 comprising C at position 101 of SEQ ID NO:248 or G at its complement by contacting said nucleic acid with an oligonucleotide that specifically hybridizes to said C or said G, detecting said C or said G, and administering an anti-IL12 antibody or an anti-IL23 antibody to said human.

2. The method of claim 1, wherein said testing comprises amplifying said nucleic acid by polymerase chain reaction (PCR).

3. The method of claim 1, wherein said testing comprises amplifying by polymerase chain reaction (PCR) a fragment of said nucleic acid that includes said position 101 of SEQ ID NO:248 or its complement to thereby create an amplicon containing said position, and contacting said amplicon with said oligonucleotide.

4. The method of claim 1, wherein said oligonucleotide is detectably labeled with a fluorescent dye.

5. The method of claim 1, wherein said oligonucleotide is an allele-specific probe.

6. The method of claim 1, wherein said oligonucleotide is an allele-specific primer.

7. The method of claim 1, wherein the nucleotide sequence of said oligonucleotide consists of a segment of at least 12 contiguous nucleotides of SEQ ID NO:248 or its complement and includes said position 101.

8. The method of claim 6, wherein said testing comprises detecting the presence of an amplicon.

9. The method of claim 1, wherein said human is homozygous for said C or said G.

10. The method of claim 1, wherein said human is heterozygous for said C or said G.

11. The method of claim 1, wherein the anti-IL12 antibody or the anti-IL23 antibody comprises an anti-IL-12p40 antibody.

12. A treatment method comprising administering an anti-IL12 antibody or an anti-IL23 antibody to a human identified as having an increased risk for psoriasis associated with the presence of a polymorphism rs12522665 comprising C at position 101 of SEQ ID NO:248 or G at its complement relative to the absence of said polymorphism.

13. The method of claim 12, wherein said human is homozygous for said C or said G.

14. The method of claim 12, wherein said human is heterozygous for said C or said G.

15. The method of claim 12, wherein the anti-IL12 antibody or the anti-IL23 antibody comprises an anti-IL-12p40 antibody.

* * * * *